United States Patent 12,576,115 (BACTERIAL COMPOSITIONS FOR TREATING AND PREVENTING HALITOSIS) - sequence listing, part 10

SEQ ID NO: 23 - DNA, 2085835 bp, Leuconostoc mesenteroides
  source 1..2085835: mol_type = genomic DNA
ccttttggtagataatgggttaaaatgagaacatcagttaccataagtagcgcattttagaaaatcattggttgatgaaaaatggtacgcgtgaaactccagtaacaaacagtttagcaggtaatgctgctcgggatcaccgttattgataatgaagtgttatggtttatttatataatcataaaaattgggtggtaccacggaaatgcgtttttcgtcccttgtttagcgacaagagaagaacgcgttttttattttatgaaaaagaggacatattaaatgttagatatacgttatatgcgtaaaaacagcgcagaagtcaagcaacgtttagaagaccgtggcgttaacccagaaacaattgacgagttattggaacttgaccaaaaacgacgggatttgatccaaaaagttgagtctcttaaagcacaacgtaatgatgtatcagataaaattgcttttgctaagcgtcaaaaagaagatgctagtgaagcaattttgcaaatgaagcaagtcggggcagatattaagagtcttgataatgagcaaacattgctggatgaacaggttcgagaaatcgctgctcatttgccaaacatggctgcttttgatgtaccagttgggccagatgaatctgctaacgtagaacaacgaaagtgggccccagaggaatatggatcacgtccgcatgccttagaagaagcatcgtgggttaaagctcattatgaaattggagagaatctggggatacttgactttgagagaggcgcaaaagtttctggtgcccgcttcttatactacgttggtgatggggcaaggcttgaacgtgctgtctataactttatgttagatgagcataggcaagaaggttacactgaaatgatcacgccgattgtggtgaatgattcagcaatgtttggaacaggacaatatccaaagtttcaagatgatgcttatcgtgtagaaggattgaatcaaacatatattccaacagcggaagtccctttgactaactattattcaggtgaagaattgccaagtgaggacttaccaatcaagttcactgcgctgtcaccttctttccgtaaagaagcgggatcggcaggtaaagatacgcgtggattaatccgtttgcatcaatttaataaggttgaaatggttaaatttaccaaaccagaagattcttacgaagaattagaaaagatgacactagatgcggaaaacattttacaaaaattgaatttgccttatcatgtgattgtattgtcaacaggcgacatgggattctcagcagcaaaaacatatgatattgaggtctggatgccacagcagaacgtttatcgagaaatttcttcagtatcaaacactgaagatttccaagcccgtcgaatgcacattacctatcgtgatgcagataataagttacagcttgtgcatacattaaatggttctggtctagcagtagggcgaacagtagcggctattttagaaaactatcaaaatgaggatggttcagtaactattccagaagttttgcgaccttatttaggcggacaagagaagcttgaaccaacaacacaccattaattcaaaggaagggtctatattttggactctttttttggtataattagtcatataatacacatattttgcagtaatatacaaaaaatagattttagaggagaaacgagcgaacttactactcgcacgttaaaagtaatggccaatccaatacgtaaattagttgataattcaaagcaacaactaaagaaattaaataaaattgccgatcaagtcgaaagttatgcagacactatggctagcatgtcagatagtgagttacaggctaaaactggagaattcaagtcaaaaattgctgatgcaattgatggtattgaggacaaggataagcaaaataaggctttggcaaaagttttagacgagctgttaccagaagcttttgctgtggcgcgggagggagctaaacgagttcttggtttgtatcctttccatgttcaaatcatgggatccatcgtattacacggtggaaatttagctgaaatgcgcacaggtgaaggtaaaaccttgacagcaacaatggctgtttatttaaatgcgttatcaggtcgcggtgtgcatgttgttacagtgaacgattatttatccgctcgagatgcggaacaaatgggtcaattatacaattggcttggattgacagtcggtgtcaatgttggtgatgcgccagcagaagaaaagcgtgctgcttacaacgctgatatcacttattctaccaactttaacatcgggtttgattacctacgtgataacatggtacgacgcgcagacgagcgtgttatgcaacgaggattgaactttgcacttatcgatgaagcagattcaattttgattgatacggcacgtacacctttgattatttctggaccaggttcaggagtctcccaactttatgctcgcgctgaccgtttcgtgaaaactttgcaacgtgatgaggactttaaggttgatgaagaagccaaggcgactttgttaacacctgaaggaattcacaaaggcgagatattctttaacttgaataacttatatgatgctgacgatacagccttaacgcatcatattgaccaagccttgcgggctaattttaattacattaaagataaggattatgtcgttcaagatggcgaggttaagttgattgatcagtcaacgggccgtatttctgaaggaacacgtttatcagacggtttgcaccaagctattgaagctaaagaaaacgtcgagattcaagaagaaaataaatcaatggcgcaaattacttatcaaaatttgttccgtatgtataagaaactttcaggtatgactggaaccgctaaaactgaggaagaagaattacgtgaaatttacaatatggaagtaatcagtattcctacgaaccgtcctgttagacgtgtggataaacctgatttgctttatacgtctattcgtgccaagtataatgcggttgttaaattgattgttgaattgcatgaaaagggacaacctatcttaattggtacgggatctgtcgaagattcagaattattatcaaaaatattgatgacgaaaaatttgcctcacaatgttttaaatgccaaaaacaatgccaaagaagctgagattattgctaatgctggacagcgtggtgcaataactgttgcaacaaacatggctggtagagggactgatattaaacttggtcctggtgttgcggaactcggtgggttagttgttattgccacagaacgtcatgaatcacgacgtattgataatcagttacgtggtcgtgcaggacgtcagggagatgaaggcttttcacaattctttctttcattggaagatgatttgatgattcgttttggtgctgaacgtgtccgcttgatgatgcagagaatgaatttggatgaagatacagtgattaccaatcggtttattactcgttctgtcgaatcagcccaaaagcgtgttgaaggaaacaactatgacacacgtaaaaatgttttgcagtacgatgatgttgtacgtgaacaacgtgaattgatttatcatgaacgtgatgttgtcattgatgaatcagagtcattggaatgggttttgatgccaatggttgaacgtactattaaccgtgtggtggatgctcaaacgaaagagaagaagtcttccgattggaatctgccgcaaattgttgcttttgttggcaatgccctagcacatgatgatgccgttacagtgcaacaactgcagggattgactcgtgatgaaatcaaagcaaaattattagagttagcgaagttgaattataaagaaaagcaaagccagctttatgatccagaacaaatgttggagtttgagaaagttgttattttgagagcagttgatcaacactggacagatcatatagattctcttgatcggttgcgtcaaggtgttggtttacgtggatatggacaattaaatccactcatcgaatatcaaagcgaagcatttgcgaactttcaaaaaatgattgcagatgttgaatatgacacaacacgcacatttatgaaagctgaaattcgtcagaatttacgttcttaatatacaaataaaagcgaactttgttcgtttttattttgaaaggaattaatatggaaattatcgatgcaaagcatgccgttagtgatatgcaggagaatatcgaacgttttcggggaacgctcgatatggaagcacttacggaagaaattgctgattatgaaaatcgtatgacggaacctgatttttggaacgacaatgaaaaagcgcaaaaggttattgaagaaaataatgttttaaaaaatcgtcgtgattcatttttgaatttaacaaatcaagttgaagaattagaactattaatagaaatggctgtggaagatcctgaggatgaggacacgctaggtgaacttgaagcaggggttgcgaaggcgcaaaaagatattgatgcttataatttagagcaactattaactgagccgtatgatgcaaataatgccattttagaaattcatccaggatctggtggtactgagtcgacagactggggtgctaacctatatcgtatgtacacgcgttgggcacagcaacatgattttcaagttgaaaccttagattatcatgcaggcgatgaagcgggtattgatagtgcaacgattaaagtaactggacataatgcctatggctttttacgaagcgaaaaaggtgtgcaccgtttcgtaagaatttctccttttgatagcgctggtcgacgtcatacgagtttcgtatcagttgatgtaatgcctgagctagacgattcaattgaggttgaggtacgtgatgatgatgttaaaatggatgtgttccgttctggtggcgccggtggacaaaacgtcaacaaagtttcaacaggtgttcgtctaacgcatgaaccgacagggattgttgtttcatcaactgtagagcgtactcagtatggtaaccgtgattatgccatgcgtctgttgaaaagtaagctataccagttggaattagagaaaaaagaagctgagcgtgcggcgttgacaggcgaaaaaatggaaaatggttggggatcacagattcgctcttacgttttgcacccctatcaaatggttaaggatcatcgaacaaattatgaaactaaccaaccacaagcagtactggatggtgatttagatcctttcatcaatgcgtacttgcagtggcagttatcacttaaaaatcctaattaataattagtcgaaacattactgtttcgactttttaaattttataagtataaaatagactaaacaaaaagatttcctaataaatgtttaataggttataatataagtcaatataagacgtaggcagcctaattttaaggaggcaaacatggataataattatacaccaagtgcgcaaaatgtattggttttggcacaggaacaagcaaagtattttaagcaccaagctgtgggtacagaacatcttttactcgccctagcaatagaaaaagaaggcatcgccagtaagatattaggtcagtttaatgttatggacgatgatattcgtgaggaaattgaacactttacaggatatggtatcactagtcggtatgataaaaacatctatttaccttattcaccaaaagcggcagatattttacatcaagcgaatgaagagttgcgtgctttagcacaatcaaaagttggaacagagcacattttgttagctttattacaggatgaaagcatactatcttcacgaattttactagcattagacgttaatttacaagatatgcgtcgtgcaattcttcgaaaattaggcattactgatgtgcggaagcaaatgaagcaacaggagaagcagcaagcatcagcgggaacgcctactttagatggattggcacgtgatttgactcaaatggcgcgagacaacaaaattgatccagtaatcggtcgcccaaaggaggttcgtcgtgttatacaaatactatccagacgaacaaaaaacaatcctgtattgattggagaacctggtgttggaaaaactgccattgctgaaggactggcacaaaaaatcgtagacggtgaagtacctgaaaacttagccaagaaacggttgatggcattggacatggggtcactggttgcaggaacaaaatatcgtggagaatttgaagaccgattaaaaaaaatcattgaagaaatttataatgatggcgaggttattctatttatcgatgagttgcatacattgattggtgcaggtggcgccgaaggcgccattgatgcatcgaatattttaaagccagcattagcacgtggtgaattgcaaactttgggtgctacgacatttgatgagtatcaaaaatatgtcgaatccgatgcagctttagagcgccgctttgcatcagtaacagttgatgaaccaactcaagatgatgctattgctattttgaaaggaattcgttctcattttgagaaacatcatcaagttcagattgatgatgcagctattgaagcggctgtgaaactttcggctcgctatatttcggatagatttttgcccgataaagccattgatttgatggatgaagctggagcaaaagtacgtattgatgccactgggaaagcaacaccaatatcgaaagccaaggttcgttttgcagaagttcaagcggaaaaagaagctgctattacgtcattggactttgaaaaggcagcccagttgcgcactgaagagatgaaattgaagcagaaactggcaaagtcagaagctaaagatactcaaaataaccaaaaagaaaatgctgaacgatattcgcttcatgttacagaagaagatattgctgaggttatttcgcaacaaaccggtgtgcctgttatgcaaatggaaaagaacgagcaacaacgtttggtcaatttggagtcagttctggggcgtcgtgttattggacaaaagacagctatatccgcagtggctagagcaattcgtcgtgctcgttctggattaaaagaccctagtcgcccgattggtacatttatgtttttgggaccaactggtgttggaaaaacagaactagctaaagcgttagctgaagcaatatttggcagcgaagataacttgattcgaattgacatgtcagagtatcaggaacgttggtcatctagtcgtttgattggttcggcacccggatatgttggttacgacgaaggtggccaattaacggagcaggttcgtaatcatccctattctgttgtcctattggatgaagcggaaaaagcgcatcaagacatctttaatttaatgttacaggtgtttgatgatggttatttaacggattcaaaaggacgaaaggttgatttcaaaaacacaatcatcattatgacttccaatcttggtgcaacacgattgcgtgatgaaaaatcagttgggtttggtgcagttgatttgaaggacaatcacgaagcagtagctgcaaaaatacgtgaaaccttaaaagaaacattccgaccagaatttattaaccgactagatgaagctatcgtgtttgaaagtttgacgaagcctgaattgcatgaaattgtcaagctaatgagtcgttcagttctacagcgtgttgctgagcaaggtatcagtgttaagataacaccagcagcaattgacgtggtagcttcagcgggatttgatcccgaatatggtgcgcgtccaattagacgtgcactccaaactaaagttgaagatgcattaagtgaagaattactgcgaggtaatatcacaactgatgatgcggtaacgattggtgccaaaaatggtgaaatcagaattagcacaaagccattaaagaaagatacgacaaaagcgtaagtttttaaagtaaaaataatatgtaaagattagtgattacccaaccaccgcttaaaaacggtacaaagggtaatcttttttgttgtgagtataatagatagagtaaagccaggcaacaactgatgagtaaagtacaagaaaaaataacaggcgtgtttgatagtactaaacttagtagtaccggtatatcaccactgcctaatgtgtgccgatgttttacgagaattatagataaaattaaaatgaggactgttaaacacagatgtgcagcatcatgatgaagtataagtagatagcctatccagggaaataaaatattcgcgtgtatgctttgtttcgaacagtcttctaacgataaaaataataataagactcctgtaatccaagttacaggtgtagcccataagagtgtgccaattaatatgtaagacaattcaaaaatagcatagtagtgaccaaaatgagcatgacaatagcgacatttgttgcgtagaacacatgccgaaataactggtataatatcaaaccaagctaaattatgatcgcaataaaaacaaaaagagcgttgtattttcaaagagacactgttggacaaccgagccgcagcacatataatagttgagacgataatactattaaacaaaaagacaaatatattttccataacttatcatacgttgtggtaatcattttttcatttagcatggaaagttgttaaaacctattgacaacacggctcaaaatggtattatattgaacgtgcttttgagtaatctgttctgtgacatcgtcacactgtgctgaacggcgctgtaaaggcaattgtcagcagattttcagtgatatgatttttggaaatataaaaatgatacacctggaactgtgaaattaatgaaaatttaaaggagactgtagcatgcctacaattaaccaactggttcgtaagccacgtaagtcaaaggtttctaagtcaaaatcacctgctttgaactttggctacaactcaatgaagaagaaggcaactaataatgctgcaccacaaaagcgtggtgttgctactcgtgttggaacaatgacacctaagaagcctaactcagctttgcgtaagtacgcccgtgtgcgtctttcaaacttatatgaagtaactgcatatattccaggtattggacacaacttgcaagaacactctgttgttttgattcgtggtggccgtgttaaggatttgcctggtgtacgttaccacattatccgtggagctttggatactgcgggcgttgatggtcgtatgacttcacgttcaaagtatggcacaaaggcaccaaagaagtaagaaggagactgactaatgccacgtaaaggttatactaagcgtcaggaaattttgcctgacccaatttacaactcaaagctcgtttcacgtttgatcaacaagttgatgcttgatggtaagcgtggtacagcttcaacaattttgtacgatgcttttgatcgtatcaaggaagcaactggtaacgatccattagaagttttcgaacaagctatggaaaacattatgccagtattggaagttaaggctcgccgtgttggtggttctaactaccaagtgccaatcgaagttcgtccagatcgtcgttcaactttgggacttcgctggttagttaactactcacgtttgcgtaacgaacatacaatggatgaacgtttagctaaagaaatcatggatgccgctaatgatactggcgcatctgtaaagaagcgtgaagacacacacaagatggctgaagcgaaccgtgcatttgcacactaccgttggtaaaaatttgatactgaggctagtagataatacaacccttggtatgcagatagtgtacaattgtcatagatggtgtttgtcacacacaagcaccgtcaaaaagcgaacacaactatgtgtcgctttttgttgcatatagaactaaaccaggagataactcacaatggcaaaacgtgaatacccactagaacgtacacgtaatatcggaatcatggcccacattgatgcgggtaagacaacgactactgaacgtatcttgtactatacaggtaaaattcacaaaattggtgaaacacatgatggtgcttcacaaatggatttcatggaacaagaaaaggaacgtggaatcactatccaatcagctgctacaacagctgtatggcatggtttctttgaccaattcgctaaaacaccttaccgtgtcaacatcattgatacaccagggcacgttgatttcacaattgaagttgaacgtgcattgcgtgttttggatggtgccgtagcggttttggatggcgctgccggtgttgaaccacaaactgaaacagtttggcgtcaggcaacaacatatgatgtaccacgtatcgtatttgttaacaaaatggataagttgggtgctgacttccaaatgtcagtggattcaattcacgaacgtttgcaagttaatgcagaagctattcaatggccaattggtgctgaagatgacttcgaagcggttattgacttaatcacacaagaagcatactatcctgaagatgatttgggcgaaaagtgggcacctcgtgaaattcctgaagaattgaaggaattagcagaagaaaagcgcaacacattgattgaagctgtagctgatgttgatgatgatttgatggaaaagtatcttgaaggtgaagatatttcaatcgaagaattaaaagctgcaattcgtcgtgctactttggcattgcaattctacccagttcttgcaggctctgcctacaaggataagggtgtccaaatgatgttggatgcggttgttgattatttgccaggacctttggatgttaagccatatatcgctaacgacccaaagactgatgaagaaattgacttgattgctgatgattcaaagccatttgctgctttggcatttaaaatcatgactgatccattcgttggtcgtttgacatttatgcgtgtgtatactggtactttgaagtctggttcatacgtacaaaacacatcttctgatactcgtgaacgtgttggtcgtttgctacaaatgcatgctacttcacgtactgaaatcgaagaggtattctcaggtgatatcgctgctgcgattggcttgaagaatacaacaactggtgattcattgacagatgttagtcatcaattgattcttgaatcaatggaattcccagaacctgttattgaattggctattgagccaaagacaaaggctgaccaagacaagttgtcaaatgctattcaaaagttagctgaagaagatccatcattccgtgcaacaacaaaccaagaaactggtcaaactttgatcgctggaatgggtgaattgcaattggatatcatggttgatcgtatgcgccgtgagtttaacgttgaagcaaccgttggtgcgcctcaagttgcttatcgtgaagcgtttaccaagacagttcaagctcgtggattcttcaaacgtcaatctggtggtaagggtcaatatggtgatgtttatattgaattcgcaccaaacgaagaaggcgctggctttgaattcgaagatgctattgttggtggtgttgtgccacgtgaatacatcccttcagttgaagctggtttgaaggatgcattaaatgctggtcctttggctggattcccattagttgacttgaaggctaagttgtatgatggttcatatcacgatgtcgattctagtgaagctgcctttaagattgctgcatcattggctttgaaggaagctgcaaagacggctggtgcggttattcttgaacctatcatggctgttgatattgttgcacctgaagacaaccttggtgatgttatgggacatgtctcagctcgccgtggtatgatcgaaggtcaagaatcacgtggacctgtattggctgttaaggctaaggttcctttgtcagaaatgtttggttatgcaactactttgcgttcagctacgcaaggtcgtggtacattccagatggtatttgaccactatgaagctgttcctaagaacattcaagaagaaatcatcaagacaaacggtcaagaagattaattctaatatttaaatatttaactgacagatggttcagtataaacggcgtcactcatattgagtgacgccgttttaataggaaaaagtaaaatgctgaaaaataataaaaatcatagtaaatttttagtacccgggataattgttgtgggaatggttttacgcttacccttcacgtctattccaccgatattggggaatattgcgcgttcattgcatgtaccggtttctagtctaggaatcttaacaacgatacctttattggcgttcgccattttttcagtttttgcgccaaaggtagcacaaaagttggggttagaacgtgctttcacactcatgcttggattgcttattattggttcgttcattcgaatcttaaatacaccgcttctctacattggtacggcatgcataggagttgcaattgcacatatgaacgttttattgcctagtgtgattcgaacgtatttcccacaaaaagttggttttatgacttcgatatttacatttagtatgatgctagcgactgctataggggctgcgttatcggcacctattactgctgtaactggttggcatacatttataattttgttaacagttttactaataatcgcattacttgtttggttacctaatcaaaattttgttcataataatcaaacaactgttaaaacaaaatctgagaatgttttgaaacccagtatttggcgaaataagtatgcttggctattgttgttttttagtggtgtacagtcaattatgttttatatcctattagcctggggaccaacgatggcagtgcagaccggtttgtcggcttctacggccagcctgtttgctggcttgaattcattgattggtctgccatttgctttgtttattccatcaattgttgccagacttgatagtgggcaacggcagtggctagtggggatgttctcaatattgggcactttaggatatatgttgttacttttcccgcaaggaacgtttacctattggctgatcgttaatctattaatcggggttggcacatcagcattattcccatacttaatgacaacgtttagtctaaaaactagtaatgcagaacaaacagcacggctgtctggcatggcacaaagcggtggctatttattagctgcaacggggccactgttatttggttatgcatatggttggtttcattcttggattccgcaaattattatgttaattatcttatttattctgatgacagttgcaatattaattgtggaaaatcaagataaaattttggattaaaaagcgcaagtcatcgcgctttttttgtttttataattagtgtaaaatgtattctattgaaaagattcgagggtgagcaagtgagtgagaaacaagtaccaattattgcttttaatcaagtagatttgtcttttggagatacacatgttttaaataatgttgatttagagatagaagctggtaaattttatactttacttggaccatctggttcaggaaaatcaactatcttgaaactgatttctggacagctaacggctgactcaggagatatatcttttgaaggtcaacgtgttaatgatgtacctgcggaaaagagaaaagtgaataccgtattccaaaactatgcattatttccaaatatgaatgtttttgataacgttgctttcggtccaactttaaaaggaatgaataagacggaaattaagaacaaagtgaaagaaatgcttaatttggtcaagttaagtgattttgttgatcgcgagattgatgagttatcaggagggcaacagcaacgcgttgcgattgcgcgtgctttggctaatgacccagaggttttattacttgatgagcctttgtcagctttagactacaagctacgtaaaagtatgcaatatgaacttcgagaaattcaacagcgcttagggattacttttgttttcgtgacacatgaccaagaagaagcattggctatgtctgattggatatttgttatgaatgatggtgtaattcaacaaaatggttcaccagaagatatttatgatgaaccaatcaatcactttgttgctgattttattggtgagagcaatattgttgatggcatcatgaaggaagattatgtggtccattttgtgggtaaagattttgaaaatgttgatgcaggaatgcgccccaacgagagagttgaagtagtgttacgacctgaggacttagatttgacgtccattgaaaatggtaaattagtcgttactattgaggaccagtcatttagaggagactactatgaaattacggctagagatgatgatggcaatgaatggcaagttcaggcaacaaattcggcaataattggtgctagagtaggtttgacatttgatcctgaggatatccacattatgcgatttaatgagtctgaggacgattttgatgcgcgtctggaaagttatgaggacgatgatgaaatctaaacaacaacgtcaaatattttatattattccttatggcatctggctattactatttgttattacgccattgatactaatgttatttcagtcatttactactgctagtggacatttcacatttagcaattatgcggcctattttggcagtggaacatatttgcgaatgaccttcaactcagtatggtacgcatttttgataacagtgattactttagtgattagttacccaactgcctatttattgaatcaactgaaacaaaaacagttctggctattgttagtcatattgcctacatggattaatttactgttaaaaacgtatgcttttattggactattgtccaagactgggactgtgaataatttcatttcactttggggcattgcgccccaacagctcttattttcggactggagttttttgctggtggcggcgtatatcgaaattccttttatgattttacccatttttaattcgttagcggagattgattcaagactttctcaggctagccacgatttgggtgctaataagtggcagacactccgctacgttatcttcccattgtcgatgccaggtgttaaggccggtattcaggcagtgtttattcctagtttgtcattatttatgattacacgcttgattggaggtaatcgagtgattaccctaggaaccgcaattgaagagcacttcttggtcacacaaaattggcaaattggttcaacgattggcgtagttttgattgctgcaatgattgctacaatgctgctgacacgtgatcgtacacgtaaaaatctaagaaagtgaggtatggctaatcatgcataaaaaatttagatggtctaatttgtatttagtgtttgtatttgttttgttgtacttacctattttctttttgattatttactcctttaatgcaggagatgttatgcaaggatgggatggcttttcattgaagcattacgccgagctctttgtcgacacaagaattttagagattgtggttaacacatttctagttgcgttattatcttcactactggctagtataattggcacagcaggggctctatatatctataatcaacgtcatcaattggcgaaaaatattttcttgtcacttaataatattttacttgtttctccggatgttattattggcgcctcatttttaattctatttaccgttgttggttttacactcggttttacttccgttctactttcgcatattgcttttagtataccgattgttgttttgatggtattacctcgtttacaggagatgaatccttatttagtcaccgcagccaaggatcttggtgccaataatttacaaatgttgtctagggtagtattaccagttatatcgccgggaattttagcgggattttttatggcgtttacttactcactggacgactttgcagtgacgttctttgtaacaggaaatggtttttcaactttgtcagttgaaatatattcccgtgcgcgccaaggggttagtttagaaatcaatgcgttatcggccatgatgtttttggtttcactactattagtattaatctattattttatttccaacagatcttctaaaggcaaaaagcgcggcggaacaaaccttgtaatgccagctacggagggactgtaagatgaaaaaattattatccagtgtagtggggatattaattgttgttgctttactcattagtgcgcagcattatttttcggcacagacaggcacgggggacaagagcggcaaagttttgaatttatataactggggagattatattgatcctgccttattaaaaaaatttaccaaagaaactggctataaagttagttatgaaacttttgattcaaacgaagcgatgtatatgaaagttaagcaaggcagtacatcgtacgacttagcagtgccttcagaatatatgattgaaaaaatgaaagcagataatttactattaccacttgaccatagtaaattaactggtttgaataattacgatagtcgttttctaaatcaatcttttgataaaggtaataaatattcggttccctacttttggggtacacttggcattatttacaatgataaatatgtcaaagccaaagacattcaacattgggatgatctttggtcatcaaagtttaaaaatcaaatcatgttaattgattcagcaagagatgttttgggtatcactttaattacacaagggaagtccgtgaataataaatcggtagctgatttagctgcagcacaaggaaaactaacaaccttgatgccgaatgtcaaagcgattattgctgacgagattaaaatgtatatggctcaggatgaagctgcaatagccgtcacctattctggtgaagctgcagaagcaatggacaaaaattctcatttgcattatgttgtacctagtgagggctcgaatttgtggtttgacaacattgtgatgccaaaaaatgctaaacataaagcagcagcatatgcatttttgaatttcatgagtgaaccgaaaaacgctgctcaaaatgcagagtatattggttatgccacaccaaataagaaggcgttgtcgttattaccaaaatcaattcgggaagataaacagttttatccaaatgaaaaaacagtccgaaatttacaaacatatgatgatttaggacaaaaatggacagagaagtataatgatgcattcttagagtttaagatgacgcagcgatgaaataaagttagtagatttagttgtggaaatttattgaaagagggtaataaacatttttaaattaaaagaacaaaacccttgcaaggcaagggtttttctgttattatatttaagtacgcttttggaacagtagtagtaaaaccctaccgaaagcctagtgtatcaatgtttagcgatgatgattaaggttgcgacacgcgcggccgcgttgccatgggcgcgcaaaacacaagcagtgttgtcggtttttaatcgaagttagctgatttacaaaatcaacgaggaggcatgaaataatggcacaaaagaagatccgtatccgtttgaaggcatacgaacaccgtatcttggaccaatcagcagaaaagattgttgaaacggccaagcgtacgggcgcagaaattgctggtcctattccgctaccaactgaacgtacattatatacaattttacgttcaccacataagcataaggatagccgtgagcaatttgaaatgcgtacgcacaagcgtttgatcgatattgtgaaccctactgacaagacagttgacgcattgcgtaagcttgaattgccatcaggtgttgcaattgaaatcaagttgtaatccataacggatataactttcatgcctcattgaggcaaaattaaaataagaaaactatttaaggagattagtcatgactaaaggtatcttaggccgcaaagtcggtatgactcaggtttttacagaatctggtgaattgatcgccgtgactgctgttgaagcagcaccaaacgtcgttttgcaagtaaaaaatgcagaaacagacggatacagtgctattcaacttggttaccaagacaagcgcacagttttgtcaaacaaacctgaacaaggccatgcttcaaaagcaaatacggcccctaagcgctacgttcgtgaaatccgcaatgcgggagacgaatttaacgttggggatgagattaaggttgacacattccaagcgggcgaatacgtcgacgtaacaggaatcacgaagggacatggtttccaaggtgctatcaagcgtttgggacagtctcgtggtcctatgactcacggttctcgttaccaccgtcgcccaggttcaatgggtgctattattaaccgcgttttcaagggtaagcttttgccaggacgtatgggtaataataagcgaacaatgcaaaatattgccattgttcatgttgatgttgaaaacaatttgttacttttgaagggtaacgtacctggtgctaacaaatcacttttgacaatcaaatcaactgtaaaagtaaacgcaaagcatcctgaagttaagatggctaatgcatctgcatctgctactaactcagaagaagcttaatataaattatatagaaaggagaacaatcaatcatgactaaagttgctgtattaaagcaagatggtagtcaagctgcagaaattgaattaaatgacgcagtattcgccatcgaacctaacaacgccgttattactgatgcagtattgatgcaacgcgcatcattgcgtcaaggtacacatgctgttaagaatcgttctgcggtttctggtggtggacgtaagccttggaagcaaaagggtactggtcgtgcacgtgccggttcaattcgtgaacctcagttccgtggtggtggaattgttttcggaccttcaccacgttcatatgcttaccgtattaaccgtaaggcatatcaattggcgttaaagtcagttttgtcacaaaaagtcgctgataacaagttggtagttgttgatgctttgtcatttgaagcaccaaaaacacaagactttaagaaagttttggcaaacttgtcagctgataaaaagacattagtagttgttgatgaagacaacgaaaacgcaatcttgtcagcacgtaacttggctaatgttcaagttatgacaacaaagggtatcaacgtgcttgatgttgttaatgcagataagctggtgattgttcaatcatcaatcgaagaaatccaaggaggtcttgcctaatggatgcacgcgatattatccgtcgccctatcatcaccgaagcttcaatggcgcaaacagaacgtaagcgttatgtcttcgaagttgatacgcgcgcaacaaagcctgaaattaaaaaagctatcgaagaaatctttgaagttaaagtttctggtttaaacacagcgaacgttcgtggtaagaaaaagcgccaaggccgttatgttggttacacacgtaaattaaagaaggcaaccgttacgttgtcaaaagattcaaaagatattcaaatctttaacgaaggttaatctaaataggaggataagacattggctatcaagagttataagccaacttctgccggacgtcgtaatatgacgacttcagatttcgctgaaatcacgaagacaacgcccgaaaagagtttgttggccaaaaagtcaaagactggtgcacgtaatgcatctggtcgtatgacagttcgccaccatgctggtggacataagcaagcctaccgtatcgtagacttcaagcgtactaaagatgacaagacagctactgtaaaagctatcgaatatgatccaaatcgtactgctaacattgctttgttagtatacgaagatggtatcaagtcatatatcttggcgccaaagggattgaaggttggcgacaaagttcaatctggtcctgatgccgacattaagcccggcaatgccttgccattgagtgctattcctgaaggtactttgattcacaatatcgaattgaagcctggtaagggtggacaattggctcgttcagctggtgcatcagcacaaattttgggacgtgatggtaaatatatcatcgttcgtttgacttcaggtgaagttcgtttggtattagctacaaaccgtgcaacaatcggtgaagttggtaatgctgagcattcattgattaactggggtaaagctggtcgtaaccgttggcgtggaaagcgtccacacgttcgtggatcagttatgaaccctaacgaccatccacacggtggtggtgaaggtaaagcaccagttggtcgtccaagtcctatgtcaccatggggtaagaagactgccggtaagaagactcgcgataagaagaaggcttcaacaaagtttatcgttcgcggtcgtaagagtaagtaagggaaaggagacaactaatggctcgtagtttaaaaaagggaccatttgcggacccacacttgcttaagaagattgaagcgcaagttgattctgaaaagaaatcagtgatcaagacttggtcacgtcgttcaacaatcttcccaagcttcatcggctttacaattgccgtttatgatggtcgcaagcacgttccagtttatgtgcaagaagatatggtcggacacaagttaggtgaattcgtaccaactcgtacgttcaagggacacaagaacgacgataaaaagactggtaaataaggaggaagtgaaaaatggctgaacaagttacatcagctcgtgcgactgctaagatcgttcgcgttgccccacgtaaggcacgcttagttcttgacactattcgccgtaagagcgttaacgaagcatacgcaattttgaagttcctacctaatacttctactgaagatatttacaaggttttgaactcagcagttgctaatgctgaaaataacttctcattagaccgagaagatcttattgtgaaggaagcctttgctaacgaaggaccaacgcttaagcgtttccgccctcgtgctaaaggttctgcttcacctattaacaagcgtacaagccacctaacaattgtggttgctgagaaggaggcaaagtaatgggtcaaaagattaaccctactggattccgtgtcggcgttattcgcgactgggatgcaaagtggtttgctgacaaggctgactatgctaaccaacttcacgaagacttgcgtattcgtaagtatatcgagaaaaacttagcagatgcctcagttgatcgcattgaaattgaacgtacaaccaagtcacgtgttgacgtttctatccaaactgccaagccaggaatggttattggtaagggtggttcagaagttgaaaagcttcgtacacaattggcaaagttgacagacacagatgaaaaaggtcgctcaaagcgcgtctttattaacatcgtagaaatcaaaaagccggatttgagtgcacatttggttggacaacaaatcgctggtgatttggaacgccgtgtggctttccgtcgcgccatgcgtggtgctatccaacgtgccactcgttcaggtgctaagggtatcaaggttatggtttcaggtcgtttgaatggtgctgatattgcacgtattgaacaatatactgaaggtacagtgcctttgcatactttacgtgccgatatcgattactcatgggatgaagcaatgactgcttatggaaacttgggtatcaagacttggatttaccgtggtgatgtattgccacaaaaaaagaacagtaagtaaggagggaagcaaacatgttagtaccaaagcgtgttaagttccgtcgtgtacaccgtggtcacatgcgtggcgaagcaaaaggtggcaagacggtaacattcggtgattttggcttgcaagcaacaacttcaagttggattactaaccgtcaaattgaagctgctcgtattgcaatgacacgttatatgaagcgtggtggtaaggtttggattaaaatcttccctcataagtcatatacatctaaaggtgtcggtgttcgaatgggtaacggtaaaggtgcacccgaaggttgggttgaaccagttaagcgtggcaaggtaatgtttgaagttgcaggtgttcctgaagcaactgctcgtgaagcattacgtttggcacaacacaagttgcctgtacgtacaaagattattgctcgggaggctgaataatggctaaagcaagtgaattgaaagaattgtcacttgcggatttgcaaaagcgcgaagccgaattcaaggaagaattattcaacctacgttttcaattggctactggtcaactagaaaacacggcgcgtatcgcacaagttcgtaaggacattgcacgagttaagacagttattcgtgcacaagaattggcaaacgccaacaaataagacgaaaggaagaagctgaaaaatgagtgaagaacgtaatactcgtaaggtttaccaaggacgagttgtttcagataagatgaacaagacaattactgttgctgttgatacttatttgacacatgatgtctacggtaagcgtgtcaagtacacaaagaagttcaaggcccacgatgaaaacaatgctgccaaacaaggcgatattgttcaaatcatggaaacacgtcctttgtctgcaactaagcacttccgtttggttaagatcgttgaagaggctgttattctttaatgctctacccaaaacgtcgtaattaattgctaacaaggaggaagaaccatgattcaacaagagagtcgtttaaaagtggctgacaactctggcgcacgtgaaatcttgacgattaaagtgctcggtggttcaggccgtaagtttgctggtgtaggtgacatgattgttgctacagttaagcaagctatccctggtggtaacgtaaagaagggtgacgtcattaaggctgttatcgttcgtactgtttctgacgttcgtcgtgcagatggctcatacatcaattttgatgaaaacgccgctgttatcgtgaaggacgacaagtcaccagtaggtacacgtatttttggtccggttgcacgtgaattgcgtgacaacgactatatgcgtatcgtttcattggcaccagaagtgctctaatactgacaaggaggagccaaatcatgtttgtaaaaacaggtgataaggttcgcgtcattgccggcaaagataagggaaaagaaggcacaatcactaagactgttgctggaaaagatcgcgtcgttgtcgaaggcgtgaacatcgttaagaagcatcaaaagccttctaacgaatatccacaaggtggtgttatcgatatcgaagcaccaatccatgtttctaacgtgcaattgcttgacccttcaactaacgaaccaacgcgtgttggattcaaagtggaagacggcaagaaagttcgcgtatctaaaaagtctggtaatgtactaggctaatatcgaaaggtgaaatcattttcatggctaatgctttaaaagaaaaatatgttaatgaagttcaacctgctttgatcgaaaagtttaactttaagtcatcaatgcaagccccaaagattgataagatcgtcttgaatatgggtgttggtgatgcggtttcaaactcaaagaacttggatgaagcggttgaagaattgaagttgattgctggtcaacaaccagttatcacaaaggcaaagaagtcaatcgctgggttccgtttgcgtgaaggtatgtcaatcggaacaaaggttacactacgtggagaacgtatgtatgactttttagacaagttgatcaacatttcattacctcgtgttcgtgatttccgtggtgtatcatcaaaggcctttgatggccgtggtaactatacactgggtattcgtgaacaattaattttccctgaaattgactttgacaaagttaaccgcgtacgtggtttggacattgttattgttacgacagcgcaaaacgacgaagaaggtcgtgagttgttaacacaaatgggaatgccatttgctaagtaattggtaaataaaaatgttgttgctctaaatgagtgacgcgtttttaactgttattgacagaaatagtctataatagttaagagcgtgtcattttgcatgattacgttcaaaataaaaaggaggatatcgatagatgtctatgactgatccaattgctgattttttgactcgcgttcgtaatgccaatttggcacgtcacgaagtagttgaagctccagcatcaaaaattaagaagagcatcgctgaaatcttgaaagcagaaggttttatccgtgactttgaatacatcgatgacaacaagcaaggtgttatccgtgtatttctcaagtatggggaagatcgtaatcgtgtgattacaggaattcaacgtatctctaagccaggcttgcgtaagtatgctaaggctgaagagttaccaaaagttttgaacggtttgggaattgctattatctcaacttctgccggtgttattactgacaaagaagcacgttctaagcaagtcggtggcgaagttatcgcttacgtttggtaatatatctaagaaaggagacttaccatgagccgtattggaaacaaaacaatcactttaccagctgatgtaactgtatctcaagaaggtgcagttgtgacagttaaaggaccaaagggtgaattgtcacgtgaaattgtttcagctatcacaatgactgttgaagggaacgaagtttctttcagccgtgatagcgatgacagcaagactcgagcattgcatggcacaactcgtgctaacgttgcaaatatggtcgagggtgtatctgaaggtttcactaagacattgaagcttgtcggtgttggatatcgtgcagcaaagtcaggatcaaaattgactttgagtgttggatactctcaccctgttgactttgaagatcgtgaagaattgagtgttgaagtaccagatgctttgacaatcaaagtttcaggaatttcaaagcaaaaggttggcgatttagcagctgaaattcgtgccgtacgttcaccagaaccttataaaggtaaaggtattcgttacgaaggcgaagttgtacgtcgcaaggaaggtaagacaggaaagtaatttattactttttgtctgccaaaactttattaataataaacttaaaatggcatttgccataagaaaaggaaagcacagctatgatttcaaaaccagataagaataagctccgcgtaaagcgtcataagcgcgttcgtggaaaaatctctggtactgctgctcgcccacgtttgaacgtttttcgttctaatgcaaacatctacgctcaattaattgatgacgtagcgggtgtaacgctagcaagtgcctcaagtcatgatgccgaagtaacgggatcaaagacagaacaagcagttaaagttggtgagttgatcgcttcacgtggtaaggccgcaaagatcgaagacgttattttcgatcgtggtggttacgtttatcatggacgtgttcaagcactagcagattcagcccgtgaaaacggcttgaagttctaaggaaaggaggaatataaaaatggttgaattcgttaatcctaagtcacttggtgaattagaagaaaacgttgttgctattaaccgtgtcacaaaggttgtcaaaggtggtcgtcgcttgcgtttcgcagctttggtcgttgttggtgataagcaaggacacgttggttttggtactggtaaagcacaagaagttcctgaagctatccgcaaggctattgaagatgctaagcgtaagttgattactgtgccaacagtttctacaactattcctcatgatgtccttggtgaatggggcggcggtaagattttagttaagcccgccgaagaaggatctggtgttgccgctggtggtgcagcacgttctgttatggaacttgctggtattgccgatgtgactgctaagtcacttggttcagcaacaccaattaacgttattcgtgctactttcgatgctcttacaagcttgaaagatgccgaagaagttgctaagttgcgtggtgtttctttagaacacttagctgaataaggagcgataaaatggctgatttgaaaatcactttgattaagagtgcggttcatcgcttacctaagcaacgcgcgatcgttaagtctcttggacttggacgcgtatctagttcagtggtgaagcctaacaacgaagctacacgtggtgcgatttttcatatcgctcacctagttaacgttgaagaagttaagtaattacacaattaaaataggaggtaccgaaagatgaatttgaacgaattacaaccagctgccggttcacgtcatgtacgtaaccgtgttggtcgtggtacatcatctggaaacggtaagacatccggacgtggtcaaaagggtcaaaaggctcgtggcaaagtgcgtttggggtttgaaggtggtcaaatgcctttgtaccgtcgtattccaaagcgtggatttactaacatttcacgtaaggaattcgcagttgttaacttgaacaagttaaacagctttgatgatggtacagaaattacaccaacacttttgattgaaaacggtattgttaaaaatcaaaagtctggtattaagattttggctgttggtcaacttgaaaagaagttgactgttaaggcacataagttctctgcagcagcagttgctgcaatcgaacaagccggtgggtcaactgaggtactttaatgcttagcacgttatttaatgcagtacgtgaaaaggacattcgtaaaaaattagggtggacgttttttattctgtttatttacagagttggaacgcacataactgtgcctggtgttaacccttctgctatgtctgagatggctagttccggattaatgaacattttgaacatcttttctggtggtggcctgacaaactactcgttgttcgcaatgggcgtgtcaccatacgtgacagcacaaattattgtacaacttttgcaattagatatcgtgcctcgctttgttgaatggagtaagcaaggtgaagttggtcgccgaaaattgaataacgctacgcggtggttaacgcttgttcttgcgtttgttcaatctgttggtatcacagctggatttaattcattgtcatcctatggattagtgagtcaaaccaatagcgtaatgtcatttgttgtaatcggttctgttatgactattggaacattttttgcaatgtggcttggtgaaatgattactgaaaaaggcttaggaaacggcgtttcaatgattatttttgcgggtataatcgcccaagcaccagaaggtttctatgaaattttcaaagaaaatattctgcaagcagacagtagtgacatgcttaatggttggatatttgttgttgtattagttatagcgatgattttagtggttgcatttacgacatggtcttatgaaggaactcgtcgattacaaatgcagtatacgcgatctgccacatcatatggtagcgaagcatatctgccactaaaagtaaatgtttctggcgttataccggtcatatttgcctcatcatttattagtacaccacaaacggttatgttagcttttcaagacaaatattcatcagcccagtggtaccaaattatgcaacagatattcagtatgacaacgttgcctggtgcaattttatatactgcattgattgttgttttcacatatttttatgcctttgttcaagttaatcctgataagttatcagaaaatctacaaaagcaaggtgcatatattgttggtgttcgtcccggtgcagaaacaaaagctttcgtttcaaaactcttgttaaatttgagctttgttggatcaattttcttgggtgttgttgcattggttccgttgattgcatcggatgtctggggactcaatgaaaagattggtcttggtggtacaagcctgttaatttcaataggtgtcgctttggatctaattcgccaaattgatggtttgatgcagaaaaagaattacgttggatttattacaaaagatcagttagcagctcgggaggcaatcaatggctaaaaatttgattttgttgggtttgccaggtgctggtaaaggcacacaagcagactttattgtgaaggattattctattgttcatattagtactggagatattttccgtgctaatttggcagagaatactgaattaggacaaaaggcgcgtcaattcatggatgcgggcgacttagttcctgacgaaatcacaaatgctatggttgctgatcgtttaaaccaacaagacgttgaaactggttttatgcttgatgggtaccctcgtaatgaagcacaagcagtattcctagataagtatttatcagataacggtaaatctgtgtcagcaacattatattttgaagttgctgatacattgttgcgcgaacgtcttttgggacgtggtcgagcagatgatacacccgaagttattgacaaccgtttggcagttaataaagcggctaacttgcctttggtagattattatcaaaaagcaggtgtgttgcacacaatcgatggcggtcgtgaacttgctgatgtgtatcatgatgttaaggaagttttggacaatttaaattaattattcaaaacgccattgttgagagatatcagtttttctggtataatttgataggttaagcacttatcaacaatgttgaacattataagcacaggaggttaagtgcgtggccaacgatgtcattgaaatcgaaggtaaagtgaaagaaactttgccaaatgcgatgttccaagtggaactcgaaaatggtgctgtgatcttagcgcatgtatctggtaaaatccgaaagaattttatccgtatcttgccaggtgatcgtgttaccgttgaaatgtcaccatacgacttaacgaagggtcgtattacttatcgtttccgataagtaaaagatataataatcagttaaccgaataggaggaatagattatgaaagtacgcccatcagttaaaaagatgtgtgatgcttgccgtgttatcaagcgtaatggtcgaacaatgatcatttgttctgctaaccccaagcataagcaacgcgctggaaagtaatttctgcgtgttataaatattgattgaataaagacataactgtcattttcaaaaatactaaaggaggtaaattgttatggctcgtatagcaggtatagatttgccacgtgacaagcgaattgtcattggcttaacttacatctacggaatcggtaatactactgcacaaaaggtcttggctgaagctggcgtttctgaagacgttcgcgtacgcgatttaacgtctgaccaagaagatgccattcgtgcaacagttgacaagttaaacttgcaattagaaggtgacttacgtcgtaaggtatcacttgatattaaatcattgcaagaaattgcatcataccgtggcattcgtcatcgtaagggcttgcccgttcgtggacaaaacacgaagaacaacgctcgtacacgtaaaggcccagctaaagcaattgctggaaagaaaaagtaatttactttttcttgttgtatcctcatcgatgcgacacatgattatcgcaaccaaagttgtgtaatgttggttaatttattttaacccgagaaattataagaaagtattgaaaaggaggcaaataaatggcaggtcgtacaacgcgtaagcgtcgtgtgaagaagaatattgaatctggtgtggctcacatccattcaacattcaacaacactattgtaatgattactgatgcacaaggtaacgcagttgcttggtcatcagctggtgcacttggcttcaaaggaagtcgtaagtcaacaccattcgctgctcaaatggcggcggaagctgcagcaaaaagtgccatggaaattaacatgcgtacagttgcagtaactgttaagggtcctggttcaggtcgtgaatcagctatccgtgctttggcagcagctggcttggaagtaacatcaattaaggatgttacaccagttccccataacggatcacgcccaccaaagcgtcgtcgtgtttaattgaatttcattgctcttgctgtgaaagaaggggtaagaatttacagatgattgaatttgaaaagccaaatattcataacatcgaagaggatgcccgctacggcaaatttgttgtagagcctcttgagcgtggatatggtacgacacttggtaactcgttgcgtcgtatcttattgtcttcgcttcctggcgcagccgttaatacggtgcaaattgacggcgtggttcacgagttttcaaccgtggatggcgttgttgaagatgtcacacaaattatcttgaacctcaagaaggttgtgttggcgattgactcagatgatgaacgttcacttgaaattgatattcaagggccggcagatgtaacagctgcagatttgcagggtggtgctgatgttgaagttttgaatcctgatttgcatatcgctactgtggcagcaggtaagtcattacatatgacagtcacggcggtcaaaggtcgtggatatacatcagctgatgaaaataagaagttacgtgatgaaatgcccattggtgttttagccgttgattctatttatacacctatcgaacgtgtaaactaccaagtagaaaacacacgtatcggtgcgcgtgacgactatgataagcttacttttgatatttggacaaatggttctgtcaaaccaagtgatgccttaagtttgggtgctaagatcttagctgagcatcttggtttgttcatggatatttctcctgtagctgctgaagctagtgttatggttgaagcagagcctgttgctgctagtgcatcagattctgcaccaattgaagatctagatttatctgttcgctcatataattgtctcaaacgggccggtatcaacactattgtagagttgacggatcgcactgaagctgacatgatgaaagtgcgtaacctcggtcggaaatcacttgacgaaatccaagaaaagctcactgatatgaacttaggatttcgcaaggaagattaacacatgtctttaaattaaaaaaaggaggattcaccaatggcatatcgtaaattgggtcgtacatcttcacaacgtaaagctatgttgcgtgatttgacaactgatcttttgatcaatggtcgtattactactactgaagcacgcgctaaagaagttcgtaagacaactgataaaatgattacattaggtaagcgtggcgacttaaacgctcgccgtcaagcagctacttttgttcgtaacgaagttgcggacgttatagaagatggcgacgatgttaaagtacaatcagctttgcaaaagttgtttgatgatgttgcacctcgctttgcagaacgtaatggtggttatacacgaattctcaagacagtccaacgtcgtggcgatgctgcgcaactggttatcttggagctcgttgattaacaaaaaaacttgagaatttatttctcaagttttttttttgctaatttttacgatttaataataatgtggcaagatggcttaatttttgtcgtaatgcattatttggcaatttattcaggagatcatcaagttcctgactatattcagctaaaagagaatttagacgcgacatggcatcactttcaagaacaacattgtgaatgtgtacgagttgatcatcggtaattccatctctcaaagccagtagttccttcaattctgcattgatatctggattttctaaagcaaataagataggtgctgtgtatatgccatttcgaatatcttgaccagcgggtttaccgagtgaaagctgttcagtaattgaatcaaaatcaagatagtcatctaataactgaaaagcaatgccaagattctcacccagtttacctacaacatcaagtaattgagaacttacaccatctgagcttgtggctccaaataggacactgagtttaaataaagcagctgtcttaccggtgatttgggtgagatagttatcaaaagaagtgtcagttaaatatcgattgtgtttttgtgttaattcaccaaacaagatatttcttaaagcttctaatgctagcttatttgcttgaatattgtcagcatcatttaatagtgataacattccagtaagcaagtaatcaccggcataaacagctgtatccttaccaaaatgtgcctgaatactatcttgtccgcgtctcagtttggattcgtcaatgatatcatcgtgtattagtgtagcaaggtgcaaaagctcaatacttgctcctaacacaatagctttctgattatacggcgcatcagttaattcggagaaaagtaatgtcagtgcaggacgaactaattttccagcactagcttgtgaacgaatagcattatcaatttctgaaaaaccaatacgccaactttcagacatttctattaatacattttgaagcggtggatttaattctgggaaagtgtcccaaatttttggtaacgacggcattgccatgggagtctcttttcattgattatgtacaaagtgcgagagtaatgatcctcacactttattattataacttatttttctaattcattatatgttgattttgctttaccataccagagaccaccaaaaatcttttggagtagcggcacgacataaaaatctaaaccaaatccacgaccagaaccgttcataattgccaaactactcaacatgacaaaccagtgcgtgagttcaaacgaatgtgttgctccggaaacaatcgtaaggaggattgataataagcccaaaggccacgtaaatagtccaagtaagatacctgcgccagtaacaatttcaataaagctagcaagaccactttgccagaagaaattgtttaaatcaccggcatttcctagtgcaactaaaatccagaatatacctaaaaacaaacgtagtggtgttgaccataggacattgccaagacgtgatatgcttcccttgaacgggttacggccgtcttctgtacggaagaattcatccaacatataatggaagatggaataggctgaacggatttgagagtagaagaagaggttgataccgtgctttgcaatgctggcgataaatcctgaaaagttaaggcccattaagctagcgacagtgtaatgggatccaattgaaaccgcgaaaccgtgatactttacagcttcagaaaatgttttggctttgcctaggccaaaatcagcaaggatattagcagacgctgcacgagcagcactttcagcaccttcaacggtttgtgggattggcccggttttttcatcaacgtaagaaagtgtatctccagccacataaatgtccttttctggagtgccatcttctttagtggcgcgcatataatcatcagcctcaatacgaccaccacggccatatttgaatccccagtttgatatgaatgatttggctttgacaccagcagtccatattaatgattttgttggtaatgtcgatccgtcttggaagaatacaccattctcatcgaccccagtgactcttgagttcaatcgtatatcaacaccattgtcctccatatatttgaaagccttgtcagctaatttgcggtcttttaacatgtttaggatagaaggagatgcctcaagtaggacaagcttaatttcgctttcatctaatttgtaagtttgagccaatactttacgttgttcgataaattcgcccattagttcggcgcccgtgaaaccagatcctacaacggcaatagttaacatttgttcacgcttgtcgggatcaagctcagcggctccttgaccaataatgttttcaacgtgatttcgaattttcagtgattcttccattgaccacaattcaaatccatgttctttaacgcctggcgtaccaaaatcgtttgactgaccaccaactgctaaaacaagtttttcgtatggaatatcaccctgggttgttgagattgtctttttatctttattgatatttgttacttcagtcgttaataatttaacattcttatcttggtagaagagatgttctaaatcttcttgcacatgttttggtttaacacgttgagaagcaacttcatgtaactctgtcatgtatgtaaagtatgaatgcttatcaactaagatgatattatattctttatgacttcttagctttttagacaatgtttttgctgcgaagacgccaccaaaaccggcgccgacaatgacgatatttttctcgttcatgggatgcttcctttgtgaaatttattgtttattagcgttttacctcttctagtatagactagtttatgctaatttactaggtttatgagagtagttctttgtgaaaatatggaatttgtattgtgaaatggttccacctattttttagagaaaaatatgctaaaataagtagtaatggttaaagcgataaagatagacaatttaaagtatagttatgacgaacgctccttattcagcgattttaatttagatattgatgctggacaatgggttgcattggtgggacacaatggctctggtaaatcaactttggcaaaactgattttagggcttttagtggcagaacaaggtgatattgatgtttttgatgaacgtctgactgtcgaaactgtgcaccatgtccgatcaaaaattggcatggtttttcaaaatccagataaccaatttgttggtgcaactgttgctgacgatgttgcttttggtctagaaaatatccaggttgagagctcggaaatgcctcaaaaaatagataatgcactgactattgttggcatgcaagagtttaaaaatcgggagccacatacactgtcaggtggacaaaagcaacgcgttgccttagcaagtgtgttagcactacaacccaagattattattttagatgaagcgactgcaatgttagatcctgatggccgcgctacggtcatggagacattacagaaattaaaaaagcagtttgggaaagagttaacattagtgactattacgcacgatatggatgaagcgacactcgctgaccgagtagtggttattaatgacgggcaaaaaatcctagatggtacaccagctgaagttttttcacaacgaaaagcgctacatgaaaatggattagagctaccttttgctaatgagttagcatttcatttaaacgagaaacctaataaatatatggacgaaagagaactgatacagtggctatcaactttgaacaagtgaattttagttatggtgctggtacaactttagcgcagccaattctgcatgatattaatgtaacgataccggatggacaagtaacggcaattattggtcagactggttcgggcaagtcaactttcatacaacatttaaatggcttattgaaacctacaacaggacgagtagttattgatgattttgttttgacgagtgacttgaaggaaaaaaacttaacctctttgcgggccagagtgggtatggtttttcaatttccagaaaatcagttgttcgcaaatacagtcttagaagacgtcatgtatgccccaataaattttggttatgctaaagcagatgctgagtttgcggcaaaaactgccctgaaacaggtgaatgtctctgaggaattatgggataaatcaccttttgaactttcgggtggacagatgcgtcgtgttgctatggcagggacgttggcaagtaatccagatattattgttttagatgagccagctgctggcttagatccaaaagggcaaaaagaattgcttgcaattgtgagaggactgaaagaagcaggtaaactggtagttttcatttctcatcaaatggatcatgtaattgctgtagctgaccatgtcattgtgatgcatgatggtggtgttgtggcagaaggaacgccagttgaaatattcaataaagatctggtttggtttaaaacggttgctttggatttgcctaaggcaggacagtttgcggagcagttgcgtcaaaagggacatatattgcggcatcgtccattattattgacggaattagcgactatgttaaatgaggaaaaacggcatgaataatattatgattggccgttttgtgccaggagattcttggattcaccgtttagatccaagaactaaaatgattggaacctttatttttatttttgtgatgttgtggtcaacatcgtgggcgacctatgcatggtcaacggctttcgttgttttagcaatacgcttaacaaagcagccatttagactttattgggatggattaaaaccaattttttggctaattctatttacagtggtcttgcagcttttttttacgccgggaacaccagtattattacatgctggaccactaaaagtgacgattccgggcattattaatgctatttatgttatgattcgttttgttttaatcattttgatgtcaacaattttgacgttaacaacgccaccgacaagtattgcaaacgcgttagaatctttattgaagcctttgaaaaagatccacgtaccagtagctgaactttcattgatgctatcaatcgcgctgcgttttgtaccactgttaatggatgaaacgcaaaaaatcatgaatgcacaaaagtcacgtggtatgagcttttcaacagggggaccaattaaaagagccaaagctattgtgccattacttattccgctgttcgtgggtgcattacaacgagcactagatttagccaatgcgatggaggttcgtggatttcaagacgccacacaacgaacaaagtatcgtgtactatcttatggcagcaatgatcgcagcgcgtttttaggattaatcgggtttacgattatatttattggtattaaattttttataaaatgaggcaataagaggagaaatttatgccacgatataaagcagttatagcttacgatggtgctgaattttttgggtttcaattgcaaacaaaaaatggtgttgagtctgtacgtacagtccaaggggagcttaataaagtcatcaataaaatggcaaaaaacccatcaccgcagattaaagtagtaggtgcatcgcgcactgatacgggtgttcatgcttttggtcaagtagttcattttgatttgccattcaatattgatccagaaggcgtgcgcaaggggatgaatacgttgttgccatttgatgtggttgtaaatcatgtagaacatgtttctgatgactttcatgcacgatttaatacacattctaagcggtatatttatcgtgtatctacgactgactacaaggatccttttaaacgcaaatacacgggacatttccattggaaactggatataaacagaattaaagctgctttacctgacctcttaggtgagcatgattttgctagctttgctgcctcaggaaatgaaacggctacaactattcgtttgattactcgggctgacgtcgatgagaaaccagaagaacatgagatagtattcacctttgaagggaatgctttcttatataatcaaatccgtatcatggttggtgtactattagaaattggtaccggaaaacgaccagtacatgatattgttcgactgatagaagttaaggatcgggaacaagctaggtatactgcaccagcaagtggcctatacttggacgagattgattacaattgaacaatatttgttataatgaaaccagtactactttaagggggagtaattatgacgttttttgaagagtatattcaagcttcacgagggcttgttttcgtggcaacaactagagataatcaaccaagtattcgaatcatgggatttgcggtcagtccagaacgtgaaaatctgtggtactttaacgttgatccgacatcatataaagttcatgatatcgataataatgacaaggtagctatcattacgccatttaatgaaaatggcgcacgtattgaatcaaataatgcaactatgagacgttctgataaaacatgggcagatgttaaaccattatttattgacaacaaatcttatatgcaggggcacccagatatcgaaaatgagattgtactggaactccacattcattctgctagtcttgcgtcatatgggtataaaaaagatgttaattttgagtaaaataattgacatgagacgcttttttggttaagatagaagacggtattgtttacctcacgataagccccggaaacttattgtaaatgcttggcaaggaacggctgagtcagtaaacaactaatcaaaggagcgcaaacatgcgtacaacatttttagcaaaaccaggtgaaatcgaaaagaagtggtatattattgatgcaaaagacgtcgttttgggacgtttgtcaacagtagtagcttcaattttgcgtggtaagaacaagccaacgttcacaccaaacgttgacatgggtgacaatgtcatcatcatcaatgcaagcgaagttaagttgactggtaagaaggccactgataaggtttattaccaccactcaaaccacccaggtggtttgaaggctcgcacagctggaaactatcgtgaattcaaccctgaaaagttgcttgaattatcaatccacggtatgttgccaaagaacactttgggacgtaagcaaggcttgaacttgcacgtgtatgcaggatcagaacatgatcacgctgcacaaaagcccgaagcacttgacatcaacaagttagtttaagaaaggagaatctcaattatgactacagcagtacaatatgccggcacaggtcgtcgtaagaactcagttgctcgtgtacgtttggttccaggtaatggccaaatcacaatgaacggcaagtcaatcgaagaatatattccttttgctaacttgcgtgaagttgttttgcaaccatttaacgttactgaaacattaggtaactatgacgtattagttaacgttattggtggtggttattctggtcaagctggtgcaacacgtcacggtatcgcccgtgctttgttgacagtagatcctgatttccgtgcagcattgaaggcagcaggtttgttgactcgtgactcacgtatgaaggaacgtaagaagccaggtttgaagaaagcccgtaaagcatcacaattctcaaagcgttaatacatgtaatactgaccatgtcagtatcatcataatattaatctataaaaacacacacaattcatataattgtgtgtgtttttatatttggtttgtcgctagaaatgcatacatgatattagtccaaagaagtaagttcataaacaatccatgtaatcaaataggttgaaaatgaaacaataagcatagctgataacatggtaataatgaaaatactgagagttgtgatgtttgtacctattaacaagctaaaaaagaacgctgttacaattgtaacaattaggaagaacatcactacctgatatgtttttttgagtgcaaagtgacttatttcttgttctcgctcatctgcagtgcttagttctcctgttgtaacttgataaccatctttaagatatttttgataacagtattttagtaataggaaaaatatgctccaaataattaagatgaaccatccaccaccaaatgtaatgctagctgagttattagtggtttttggggataataatatggattgtatcattgcaaatgctatcagcggggtagtaataatattgcctgtttgctcaaaaataatttttttcatgtttgattttcctcattaatagtgaatagatcagtcagtggtgttttcagtgcttgtgctaactggaaggccaatatcaaagaaggtgtatagtttccttttctatagaaacaatagttcgccttgaaacaccaatttattttgctagagattcttgcgtcaaatgaagcgattttctaacgggttgaacattgttattaattttcattggaggcctcgcaatattgatgagcaatctacttcacttttaaatgtaattacaacatgtaattatcacaaaaatgcttgccatgtctctcagtatttggtatactattatagttgtttgagatatgggagtgtagcgaagtctggctaaacgcgacggactgtaactccgttccttcgggttcgtaggttcgaatcctaccgctcccattgccgataaaagctaacggcaaaataaattagctattgccccttcgccaagtggtaaggcatcggtttttggtaccgacatgcgctggttcgaatccagcaggggcaactattaaaggaatccttcgggattcctttttttgtataaaataaattttaaacacaaagaaaaagctatacaattaagtatagcttttgttatagtgcagctagcgggagtcgaacccgcacgccctaaacgggcacaggatccttaatcctgcgcgtctgccaattccgccacagctgcaaatatgaattgacaactatataattatacccattaaatctaatctcgtcaatagatattcaatgacagcgagcgtgtaattttgatagaatagaagtaatggagaaaacacatgagattttttaatcgaaaaaaaacagaagtaatcacaccagaaatacaggcccataatgaagctttacaaaatgaaaatgatgatttattagatcagattgaagctttgaaattagatgtttcagaactgaaatcggaaaaccaacatttgaccgaacgcctttcacgtagtaagtaccagcaaaagttaactaaaacaggtggcggactggccgttttgtttattagctacatgttgctatccttgctgggtgaaccttctcgttatatgatttggttattattaattgaggcggtctttatttttatgatgcttagaggagacgaaaaatgagtcaacataatgcttcacgtataccttttgtagttgcaaattggaaaattaataagttgcacgctgatgttgcagaatttttggacaaggtgaacggtaaggtgcctgctgaaaatgttgtggaaacaggtattgcggcacaagatttattcttgtcagacatggttcgagctacagcacagtcacccatacatattgtcgcagaaaatgttcattgggaagacagtggagcttacacaggcgaaacatcaccaaaagcattgaaagatattggcgccaaatatgttttaattgggcattttgaacgtcgaaagttttttaatgagactgattcaacagttaatttgaaagtcactgctgcacttagaaatggcttacgcccaattatcgatgtcgatgaggatatgagtacctatgcccagtttatggacgcggaaccctcagtggctcaagtggctgccgcgttggcaggcgtctctgttgaccaaatccgcaacgttacacttgcgtatgagcccacatgggcaattggatcaggtgaggccgcaagtgcggtccaagcgcaaaaagcagctcatctgatacgtcagacgctggccaagttatattcacctgttattgctgaacaagttcgcgttttatatggcggatcggtgacaccagacaacgctcgcgaaataatgttgcaaaaagatatagatggtgtgttggttggcacatccgctcttgatccagaaaagtttctacaacttgttgccattgcgcaagatccagaagtcccagaatttaatattgagaatacttaaaaagcagtgccctaaaagggtgaactcaatagttgttgcacattactttgctttatgtattgaggaaatttttggctatgactcttaccctgtgatataatatacatggtatataaccgaaaaccaaaggagaattaaaacatgtctttaatcactgatattatcgcacgcgaagtccttgactcacgtggaaaccctacacttgaagctgaagttatcacagaattgggtggctttggtcgtggaatggtcccttcaggtgcatcaacaggtgaacacgaagctgttgaattgcgtgatggagacaagtcacgttttggtggtaagggaacaacaaaggctgttgccaatgttaacgatgctatcgctaaggctttggttggtaagttcgacgtaactgaccaacgtgcaatcgatcaagctatgatcgaactcgacggtacagaaaacaagggtaacttgggtgcaaacgctattttggctgtttcaatcgctgctgcccgtgcggctgctgacgaattaggtgtacctttgttctcatacttgggtggtgcaaattcatacgtattgccaacacctatgatgaacgttatcaatggtggcgctcactcagcaaacaaggttgacttccaagaattcatgattatgcctgttggcgcaccaacagttaaggaagcaattcgttacggttcagaaactttccacgctttgaagaagttattagaagctgatggtaaggcaacttcagttggtgatgaaggtggatttgctcctgacttcgctgataacgaagaacctttgaaatatttgatccgtgcgattgaagccgctggttacaagcctggtaaggatatcgcaattgctgttgatgttgcttcatcagaattgtatgatgcagaaacaaagacatacaagttgcgttggtcaactggagaagaattcacaacacctgaatttatcaagtatcttgaagatttggcagatcgttacccaatcatttcaatcgaagatcctatcgacgaaaacgaatgggaagactgggctgcaattacagccgaattgggcaagaaggttcaattagttggtgatgacttcttcgttactaacacacaataccttgaaaagggtatcaacatgggtgctgctaactcaatcttgatcaaagttaaccaaattggtactttgacagaaactttcgaagctattgaaatggctaaggaagctggttacacggctatcgtttctcaccgttcaggtgaaacagaagacacaacaatttctgacttggttgttgctacaaacgctggccaaatcaagacaggctcattgtcacgtactgaccgtatcgctaagtacaaccaattgatccgtatcgaagaattgttggacacaactgctaagtataagggtatccattcattctataacttgtcagctgctgcccgcgaagttattgaaaacaagtaaaaaaaactaaatcggccgtttggtcgtttttttttatatgaaatgattaaaaactattttgtcttgcaaatataagtgaaaaaggagcaagcacaatggatgatttgaaacgttgctcctgggtagataattatccagattccaatattatgacaacttatcatgatgcagagtggggacaacctaaccaatatagtgacaaaaagttatttgaactgttgactttagaagtgtttcaagctgggttaagctgggagacctcgttaaaaagacgttcagggatgaacactgcattcctctcctttgatattgatttagtgtctaaaatgacaaacgaggacattgaacgattaaaaaacaatcctaatattattagcaataaactaaaaattacatcaactattcacaatgcacgagtcattagacagattcgtcagcagagggggagtttttttgactatatgtggtcgttcactgatggtcagattatcaatcaccatattaccagtggggatgaaattcccagtcaaaatgaattatcgcaacagataacgaaggacatgaagaaacaagggtttaaatttatcggaccggtaattgtgtattcttacctgcaagcaataggtatcatcaatgatcatgaacagtgttgtagttttaatccagacaatgcaagattataagtaataatgtagtcatattttttctaatacaatcctaatattaaatgtgataaactacccttagagggctcaatctatggcaaaattacagggtgttattcttttaaacactgatgctgctgcattgcaaattgttgacagtagtgggcgtcaaattgagcatgttaagcgcgaatatagcgaaaaaaatttaccattagctagtttttctgctgaagtgatgcagcgtgcattatcacagctacaacggttccaacaacttcttcgtgattatggtgtagaagatgtgcgtttgtacggtagtgaaaacttgtccaagatgctgaatgctatttattttgtcgatcaagtagaaaatgtaacgggccttgaattactttggctaaatgccaatcaagaaaattattatcggcagttggccttgcgcgtgcatgatgaaaaaattttaaatgaacggtacgcatttgtattaggcatcagctctacaagaatagacttatcctattttgaaaataatcagtttaaattctcgcagcattcagccattggtccagtacgattaacacagtccatcagagatatggctgcagagattactgaaataccagatttgataccggaatttattgatagtaaattagcagatttttggcatatgttaccgccttttcaagcaactgatacaattattttgcttggtgccgatgtattaaatcagctgtttttaaataaaaagcccaaaactacaattcataaatcagagctacaatcattaattcgtagttttaatcagatgaacaaacaagctattgctgagcaatatagcattgatttgaatgatatttggatggtcttcatggaagctgtgttggttgtcgaagtgatgtcagctgttggtgctagtaatttacatatgagtagcttgacagtcttagatgggctggtcgttaaagacaacaatgcacaaaatgatatcattactgccgcacgtggtattgcagatagatatatggttgaagagaagcatcgagagttggttctgagatatgcttggcgactatttgatcgtttaaaaagaattcatcgattgagtgcgcgtgaccggctcttattaggtgtcgctgctttgacgcacgacgttggtagttttattaattctcagaagcattatcaatattctgaagaaattctagaaggaattgattttcatggattatcaacctctgagcaacgaatgattgcgtcaattgcacggtatcatagcgctgaaactcctgataatgcactgcgatcaacgcaagagttttctccaaggcaccgtatgcgcattgctaaaatggccgcattattacgcttggcggatgcacttgatgatagccgattacaaaaaattagtaaattaactgtgtctatcggtacagaaaaaatcacagtaatcggacaatctgccgcggatttgcaattggaaatgtatatatttgcacaaaaagcacatttttttgaggctgtgtttggattgcccattgtattgaaacgtcaggggaaaaggagctgaaaagcactatgacagatctgaaacaacacaaatattatgttaatcgtgaaatgagttggttagcttttaataaacgtgtgcttgaagaagggcgcgatacacaaaatcctatcctagagcgcgctaattttttagcgattacacaaaaaaacatggatgaatggttcatggttcgtgtggcaagcttacaacaacaaatgtttgtaggtcacgataaggtggatgcatctggtttatcgcccaaacaacagctaattaaaatttctgccgctgcaggagaacaaattaaaaaccagtaccaagtattaaatcgtagtattattccgaccatgaaaaagttaggtttttcattggtccataaaaatgatttgacgaatgcacaagttaactttttgaagaaattttttgagaaggagttacgtcctgtcttaacgccgatggcgattgatagtacacgaccatttccttttttggcaaatgatacgttaaatattggtgtccgtctgaaaaaaaacgacgaacaatctgaaaaatatattgcagtattacaggttccagaaacctctggacgagtaatcgcactaccagaagaaaatcaagtgattttagtagaagatgttgtgcaactatttttagatgcgctttttccaggttataccattaaagaatcaaatgtttttcatattttacgtgatatggaattagatgttgctgatgatgaagatacgcccaatattttgcaagaagtacaaagtaaattgcaagaacgggagcgtggacgagttatccgtgtgattgtaagtgcgaacacgggtaaaatgttgatgacccaactcatcaaagccttacaggtccctgatgatagaatttatgaagtgagtggtccgattgatttaacattcatcagttcatggttgaaagtaattgatgcacctacactagaatatacatcatttcatgggtacgaaaatcccgacttgaccgctgataaaatatttgaaaatatacgaaaacgcgattatctgttgcatcacccctatgattcatttaagccagtagttcagtttattcaaacagctgctatagatgatgatgtgctagccattaaaatgactctataccgtgtatccggcaattcaccaattattaaggcactctctgatgctgctcaacgtggcaagcaggtaacggtattgcttgaaatcaaggcacgctttgacgaggaaaataatgtccattgggcgcgtgaattagagcaaaagggcgtccatgtggtctatggacttcgtggactaaaagtgcatgctaaaatggccatggtagtgcgacgggaaagtgatactattcgtcgatatgtccatctcgctactggaaactataatgatgttacagcgaatttttatacggatcttggattgctaacagtggatagcgaattaggtgcagatgtggcttcgatttttaatattctaacgggttactctgatccgagtttttttcatcaactgcatatgtcacctaatggcattcgtgagtttatttatgaaaaaataaacgtcgaaattaagaatgctaaggcaggaaaaccatccggtattaagatgaaattcaattcgttatctgatgaacgaatgattcgtcatttgtacgaagcaagtgaagctggtgtaccagtagaattgatagttcgaggaattacaatgctcaaggttggtattccaaaagtcagtgaaacgatagctgtgcattcaattgttggccgttttttggaacatagtcgggtgttcatctttcataatgatgatagtccacaagtttatttatcttctgcagatttaatgacaagaaacttagatcgacgtgttgaattgttattcccaattcgcaatgctggtttgtctcaacaggtgattaatatttttgaaatcatgtgggcagataatgttaaaacacgtgtcttacaaccagatggatcgtttgataaaattgatcgtagaggcttatcctctgttaacgcacaagaaatgtttatagctgaatctatggtcaaacaaattgagttaaagcaacaacaggaccgagaaaatacgcaaaaagaatttgagccaatcaacaacccgtttataggaggtgaatcatgactgttatagcagtaatagatttaggatcgaactcagtacggatgacaattagtagatatcatcaagatggtcattatgaagtattgaatagattacaagagatggtacgcctctctgaaggaatgggtgaaaataaagttttacaacctgaggctattaaacgtacgatgaacgccttgaagaatttcaaggaaacgctggacaagtacccaaaagcgaaaataagagcagtggccactgcagctgtccgacaagcaacaaaccaaacggcatttttgacggaatttgaagaaacaatgggtttcacgctgcaagtactaacgggtgaagaagaggcacactatgattacgttggtattgttaatacactaaacataaacgacgccttaattttggatactggtggtgcctctgcagaattgattttagttcgaaacaaagaatcagttcacgaaataagtctgcctattggcgcagtgacgattagcgaaatgttccttgagaaggatgttattaatgcggattctttgtttcaagcaactgtagccttaaggcaaatgtttggagatgtttcttggctcagtgatgccatgcatttgccgttggtggcattgggtggtagcaatcgtactttagctaaaatttctcgacgtcagcgaaaaatcactgatatgccaattcatggataccatctgagtaagcaagatgcaacagatatatatcaaaagatattaagtaaaaatctagttgaacgacagaaaatggctggattagccaaggatcgtggtgacattattgtcggtggcttattgccgttggtagaactgctgctttttctaggcggacagcaggtcatattctcacaagctggtctgcgggaaggtattttatttgaaacgattaggcaagagacagggcaacatgttattgcgccagaacccgcttcaatgacgatagactaataaaaaacagccaatatgattattggctgttttttatttatttaatgatccacccgggagtcgaacccggatttcaagaaccggaatcttgcgtgcgatccattacactagcggatcataactattcaattatagcctattttactggaatttcaaagtaagtttcgtcaccaatgtcaaataatatatgcccagaaaactggttcatcaaatctgattgaaacttggtcaggtcttcttcagatactgggactacgacgtgaacatttgtatcatactgtgtgtctattatttgataattatggctgtttagccaataatttaatgtttcgccatgcttataatcaatgctgatagtaacttgtagacgtgttagtcgttccacaaagtcaattgactcaagtccttcagcaattgtgccagcgtaagcacggatcagtccgcctgcccctaatttaataccaccaaaatagcgagttactactgcaataacatcatgtagatcatttttttgtaagacctctagcattggtatgccagccgtaccactcggttcaccattatcactatagcgcttaatgctgtcattgtcacctaagacataagcaaaaacattatggctggccttatagtggattttatttattttttctataaaatctcgagcgtcattttcggaagtaatacgtgccatgtttaaaatgaaacgtgattttttaatttctttttcccatgtgaatgctgtgggcttaattgtgaaatattttaccatataacgtattatacagcatgaatgatgaatatttctatggtcgtcaaattgtccaaccaaaagtggaaacaacgactaaacatattattgaaccttttattgggaagaagtgccaacggtgcggacagaagaataccgaggaattgcctaaccaacattattattgtaacgcttgtttgatattagggcgagttagttctcttgataatttagtttcgttaccggaaccaaatcaattttctggtactgctaaaatgacatggcaaggtgaattgacgcaacaacaggaaaaagttagcaatgaactattggtgactttgtttcaaaaaggggaacatttagtgtgggcggttactggtgcgggtaaaactgaaatgttattcccggttatccacaaagcattgtgtcaaagactacgtgtagcgattgtttcaccacgcgtagatgtcattgtggagttagcaccacgaattcagtcggcatttgaagaaactgagctaatgatattacatggcaaccaaaaagaaaactatcgatatacacagttagttttagcgaccacacatcagatgttgcggttttatcatgctttcgatcttgttattgtcgatgaagttgatagttttccgtttgcaggggatgccatgctggcttatgcggtgaataaagcccgaaaggagaacagtgctttaatttatttaacggcgacaccaacactagcaatgcgaaaaaaagcaggtaaaaaattaccgacctcttatttgccattaagatttcaccagcatgtcttacctgaaataaaagtaagattagttagcaactggcgtaaaaggctaccgaacgtcatcaaaaaacaaattattcagctcattacatctaaacaacgatttttaatttttgtgccaaaagtctctgatttaaaaccgctacatcaaaaattacatcaattatttccaagtgtacaaagtgattacgtacatgcagctgatccatttcgacaagaaaaagttaaaaaaatgcgtgacgaaaagttacagtatttaattacgactacaatattagaaagaggggttactttcccaagaatcgacgtattaattataggagcagacgataaaacatttagtgaaaatgcgctagtccaaattgcaggtcgtgtagggcgtagtgccgatcgacccaccggtttagtacaagcatatgtacaacatatcaatttaaaggttagggcagcacaaaaacagattatcatgatgaatcgtcgtggggaaaaattaaagcgtagaatggacaactaaaaaaggagaagctatgcattgtgcattgtgtcaaacacaattatttgaagtaaattcatttttgcagttttgtggcctaataagacatgaaaatagtgtgttgtgtgaaagttgtcgtcacaattttgatgcaatcaatgatcaaagttgtccagcgtgcgggcgacagcaactaaataatgacgcatgttacgactgccaaaggtggcaattgaataacaggcccagccttcatcatcgtgcattgtatcaatacaatgatgccatgcgattatttatgcaacaatataaatttaatggtgactacaaactacgtaaaatttttaatcgtgagttaataaacctagttcatacttcagatatggatttggtagtagcagttcctgttagccagcatacgatgatgacacgtggatttaatcaagtagctagcctgctagaaggcattgaattaacagaagccttacaagttaaggtaacgaaaaaaatccaacaatcacattctaatcgcagagctcgcatgaaaagagaacagccattttccataatcgacgaaaaaattattgaaggacaaagtattttacttgtagatgatgtatatacgactggtagtacattgcaccacgctgccgatttattattagcacatggggctgattctgtgaaaagcatttcattagcacgatgaaaatgaagaaattgtaatttcgcggtaaacgcttacagatatgttataatgatgatagaaccaatataaaataactgacttgatgataatatttagaattttatcattaaagaaggaaatttggaggaattagtttatgttagattacaatgtacgtggtgaaaatatcacagtcacagatgcaattcgtgaatatgtggaaaaacgcttgacgaaattaaatcgttatatcgaagaaaatgccaaggccaacgttaacttgcgcacatacaagtctgacaattctggtaaggttgaagtaactattgtgttaccttacgtagttttgcgagctgaagatactaatcaagatttatacgcagctgttgataatgtttctgaaaaagtagaacgacaaattcgtaagtataagacaaagatcaatcgtaaatccagagaaactggatttaaaggtattgattcgaagggtgaaattcctgaagaagaggtagatgattctgctctacaaattgttcgtactaagcaggttgatttgaaacctatgtcacctgaggaagctgccttacaaatggatttactaggacatgtgttctttatcttcaaagatgcagagtcaaatactgattcagtaatctataagcgggctgatggaaagtatggcttgcttgaaacagctgaatgatatgcgtcattgtgtattatcaactgcaaagtggggaacatttttccataatttagttaagaatcgtaaaagtttataaagttatccaaaagaccagttcaattgcgtatgctatattaagcagagtttaaattgaagaggtcttttatgtttggttggcaaacgatattaaaaaataaacacagtttagttaagtggctattagcaatggtgattccagtaattttagttgctgggtaccttggagcaactagtcatgtaactcagcatgcgaaccgtttaaaggtcgctgttgttaatttagataagccagcgcagtttgaaggtgaacaacaaagcgttggtgctaaattgactgatcaatttaaggccagtaaaaagttagtggtcaagaagtatagttcagagaagtcagctcgagaagccttaaagttgggacagattagtagtgttattgttttcccaaataagatgacgcagcagttggccaactttaaaagttcaggcaagaacgtgaatgttagacaagtcatagctactggtaataatcaatttgctacacaatatacgagccgtgtgctcgaagacttgattaatgaagccaatgtaaagctgagcatgggtatctcaaacgactctaccttgaaaaatttagcaaagcaaagcaatagtttggcggacaaaacatccgatttgcaagccaatttacaagttgttgggaatgctattgatacagatacagctaaagatttgcaaacagatgcgagtgatttagcaacacagttagcaacttattctgttgagcttaatacggccattagtaatagtgacaccgacaaaattaaagaagcagcagctaagataaacgacgtttcctacaaaatgcaaacaacggtagtagggggaattagtaatattgttgtgaatttgaataatacacaggctttgagtcagaagtctggtattatccaaaccgaagccacatccgtaaaaaatggtcaaactgctatctccaataaattaaaatcactgcttggggataagtccgagacgaccacttccttgacgcaaatgcttacgctaaacataactgacattaagccagttaaaaacgatggacaagtcattttgccacaggtattggcagttggtgtgacagtaatggcaatactatttggtttggtattaacaattaaaccagaaaagccagaagcacttgcgcttgaacaatggtgggataatttccaaattggtggtctattgagtgttgtaggtgcgttgttaatgacaaccagtgtattattgtggaaaataccaatcacttatttttggttcattgtaggagttgtcatactagccgagtggataatgctaagttttgtttggtacctgaaacaactatttggtcaagcaggctggtggttagctacaggaatatctgttttacaactgattatagttgctgttagttatccagcaattgtacaagatacagcatttggtatttctagaccattttggccattaacagcactaataagtgctgtcaaccacattacgtttagtggtgaaatacagcaaaacgtaatgatcttagtaatttggtggattatacttactattttattagtctcacagtatcgttttaggcaacgaaaaagtttgacagaaaaaattgatgaataaaaaaagcgagcacatttgagctcgctttttttgtcaataaattatgaattaaatatagttgaatcatcgttaaagttagtaattttagcatggtcagcagctaattcaagttgcgtaacagcaccatttttaacactaatcttggcaaaatcatgatagccaaaataatcaacaatagcacgaatagctgtaccatgagagacaattagtacattatctccatcttgatgacgagaaagaatatcgtcaaaaccgtgttgtatacggtttataaactgttgatagtcctctgcaattttgaaagggtcgccttcacgaatcaaatccattgctgcaggcataccatatttagcgataacatcggaaaaatctgagaaggtatcatttttataagcaccaagagttgttaaggctaagccagtgtgtacaccttcaaaatagccaaagttttcttcacggaagtctggtaattggatagcttgattgggtgaatcagatttattgttgactaagatatattgtgatgtgtggatagttcgtgttaagccagatgaataagcaccatcgaagtgtacgttggccagtcgagtaccggctgcataaccgtcttgaatccctttttctgttaagggggcatcggaccagccttggaaacgatgcaaaagattaaaataggtttcgccatggcgtaccatgtagatgttgactgtcataagtttcctcctgaagataactatttccattttaccacaagtgttttggtagcagaatgaaaaagatgcattcccgaaggaatacatctttgattaattggcagcaacttcatcttcagaatttttttctgaggctgcttcatcctcgtcaaaaataccattttgatttaaatcatcttttggtaaaggcaattctttgacaatgaattgagaaatataagcattatcataatccaatgctgtcaactcaaagttggcgactttcatagtgtctccggcacggaattcggggtcatgattcaagacatatccagttaaggtaactgcatcgtcattttcaagttctttgatattgcgattaaagtaacgttcaaaatcgtataatgtcatcttacctgagattttaaaacggtgatctccgagcttttcgatatagtcatcagaaacatcatcaatttcatcacgtacggtaccaaacagttcttcataaatatctttgtcagtaattagtccagaagtaccaccatattcatcaacaacaattgcaataggagaacgctttataatcatttcatccatgacatcatgtaaatccatattttctggaacagctggaatatcacgcataattttggaaactggatcagatgacttaatacgtgcttgtcgtactaaatcataattgaaaacatagcccaaaactttatctttatcgttatccgctacaacgggaaaacgtgaatatcgttcttgtaagtataagttgagtccatccgcaattgaagccgtaacatcgatgatggtcatggatgtacgatcgatcattatgtccacagcgactttatcattcatttcaaacgcacgttgcatgaaagtaaggtcttcttcatctaattcaccagctgctgctgcattcttagacaacgacaaaatttcggtttgagaataaatgtcctcttcaccgtctgtccggaagccaagtaaatgggtaataccgtttgacaagtgatctaatgtccaaatcaaaggaaacaaagcaatatggaagaatcgtacaggacgtacaataaagagtaacaccttgaccggtgactcaattgcaatgttcttcggtactaagtcggtaaatacagcgtggacaatcgtgaaaatgatcatagcggcgacagaagctaccgcgtgagcatattcagctgggataatcccagatccaagtatgatttcagcaacggtttcttcaccaatccaacctaaaatcaaacttgttaacgtaattccgacttgtgcagttgaaagatattcagttaaatgtgttgtcatataaatagcattgctaatgttacgtgaaggcttttcacgagtttcttgcaatgcctttaatgcacttaaacgtacttttactaatgaatattctgttaaagtaaacaaaatagctagtaaaaggaccaccaaaataatgaaaaaattgatgatcatagacggaccagaatccaaattcgtaaacctcttttcatattataactaatacacattataacaaagatcgtatgaggacgttggattttataactttcttaagggtgactattgtcagtattagacgtttctatgaagttaatgggaagggaacaaacatatggttcttgcgagcaattcaatatgatttataaaaaaagtatggtattatagaaatctaaacaacatgcatgcatcaatggaaatccttgatataataggattctttcctttttattgtccttttattttctagcagccttttttaaataggttattcaattcataagaacatgcgttcgctgagacaaaattagggcttgaagaattaattaaaaagggtaaacttaaagtcagtagttattagattcaaaacagaggaaataaatataaaagaggtcggtatcatggaaaaagttacagtatatacaaaatacaattgtgtgcaatgcaagatgaccaaaaagtttttagaagcgcaaggtataccttttaaagaaattaacattgaagaggaaacacaatttgttgaggaactgaaggctaatggtcatcgccaaacaccggttgtggcggtggaaggcctaccagcattttccggattccgtcctgatgtgctaaagaaaatttctgcttgattttcgttaacatcgtgcggtgcaaagcttagcggtgttttttattacattttttctagtaagagtgttgataaattgcagaagtttgttgtcaatcaaaggtagttcaaaatataaagtgtcaacacggcaatcgatcacattcaaaaccaaaggacaataaactgatgtcattaaaagagttagatttagaaaacgtaacatattttgatttaaacaatcaagtaaatattccaaagaacaatgaaattcagcttgataaagatcaagaggcattgaacgcttttttggatgagaatgttttgcccaatgtgatgcattttgattccttgcaagaacgtctggattggatgtttgatcatcgcttcttggaacgtgaatttattcaaaaatacaacctaacattcattgaaaagttatatacatatttagcgggtgaacattttaagtttaaatcctttatggcggccttcaagttctataatcaatatgcgcttaaaactaatgatggtgcatattatattgaaacatatgaagatcgtgttgccatgaatgctttatattatgcagatgggaatgagaatttggcactgcgtttggctgatgaaatgatacatcaacgctatcaaccagcgacaccatctttcttaaacgcgggccgagctcgacgcggagaattggtatcgtgctttattattcagacttcagatgatatgaactcaattgggcggaccatcaattcagcgctgcaactatccaaaatgggtggtggcgttggtatcaatctttcaaatgtgcgtgaggctggtgcaccagtcatgggtatcgataatgctgccggtggtgtagtgccaattatgaaattgttagaggactcgtttacattttcatcacaagttggtgctcgtcaaggagccggcgtcgtttatttatcagtttttcaccctgatattttatctttcttatcaactaagaaggaaaacgctgacgaaaagatacgagtaaaaacattatctcttgggttgactgtcccagataaattttatgatttagtcaagcaaaatgagacaatgtacttgtttagcccagacgatgttgagaaggtttatcaacaaccgtttaattacgttgatattactgccgaatatgacaacatggtcgctaacgataaaatccgtaagcaacgtatcgacgcgcgatcccttgaagaagaaatatctaagttacaacaagaatcgggttacccgtatatcattaatattgatacagctaatcgaactaatccagttcctggtaagattgtatcttctaacctgtgttcagagatattacaagtacaaacgccgtcagaaattgacaatgaacaacattatacaaaattaggttcggatattagttgtaacttagggtcgattaatatcgtaaacatgatgaacacgaatgatttcggtggatctgtggatgcaatggttcgggcactaacctttgtatccgattcgtctaatttggatgttgttccttcaatcgatttaggtaacaaagaaaaacatgccatcggcttgggtgctatgggactagcagcatattttgcacaaaataagatgtactatggagatgaagaagcattagactttacatcaacatttttcatgatgctgaattattattctattaaatcttcaatgggcattgcaaaagaacggcatgaaacgttttatcagtttgatcaatcgggttatgcggatggaacatactttgacaagtacgttgaaaagaattggacgccaaaaaccgaaaaagtggcaaaagcctttgctggttttgatgtgccaacagaacaagactgggcacagttaaaagaagacgtagcaaaatacggtatgtataatgcctatcgtcatgcaatcgcgccaacaggttctatttcttatgttaacgatgcaacggcctctttgttgccaattgttaacaaaattgaagaacgtcaagaaggtatgattggtaaggtttactatccagcaccgggattaagcaatgaaacaatgccatattatgtttcagcgtacgatacagatatgcgtagagtaattgatgtatatgctgctgcacaagaacatattgatcaaggaatggcgttgacattatttatgcgttctacattgcctgaacatttgtacgaatggaaaaataatcgtacaaataaaatgacgacgcgtgatttgaccattttgcgtaactatgcctttaacaaggggataaaatcgctttattatgttcgtacgtttacagatgacaaccaagaatcaggtgttaatgaatgtgaaagttgctcaatttaatttaaaagagcgcttagctatgaaatgaaggaatgaatgacaactataaatattctttatgcctctactgaaggtaatacaaaagcgtttattgaaaagttagcagctgttgctgaatctaatggtgatggattttccgcgcgtttaattggtgatgaaacagaatatgcaaatgaaacacaaccctatgttgctttcgtgccgacttatctaacaggcggtactggaacaggaccggaagttaaagaaatttttacaaatgccttgggcgattatattgcatttggtaataatgcgcgatacttaaaaggggtggttggttcaggaaaccgaaacttcaacatccaatttaacttgacagcgattcgctatggaaaaaactttgatgttccaatgattgcagcctatgaattgcgaggtagcaagtttgatgcagaaaagatatataataagataaaaccttattttggagaatgacaatggcacatataaacaacggttcatacacagcgattaactggaataacattgaagatgaattagataaggcgacatgggaaaagttaacacaacagttttggctagacacccgaattcctatttcaaatgatttacgtacttggcgtggtaacatgtccgaacaagaacgccaaacaatgaacttggtctttggcggcttaacaactttggatacattacaatcacaagatggtatggcgcaattaaagttagatgccacgaatcaaaaagaagaagcggtattgaataatattcaattcatggaatcagttcatgccaagtcatattcatcaattttcgaaacactaaatgaaaaagttgagattgaaaagatttttgaatgggcagattctaacgagtttttacaatataaggcgaatagaattaacgatatttaccataatggttcagcgttacagaaaaaaattgcttcggttttcttagaaactttcttattctactcaggtttttacacaccattgtatttcttggggcataataaaatgttaaatgtggcggagattattaaactaattattcgtgatgaatcggttcacggtacgtacattggctacaagttccaaattgggtttaataaaatttcggctgaagaacgtacagaactacaaagctggatgtatgatctgttatatgaattgtacgaaaatgaagagaaatatacacacgagttatatgatgacttaggttggactgaacaagtgctcacatttttacggtataatgctaataaagctttgatgaacttaggccaagagccaatgttccctgacggggctgaagatgttaacccggttgttatgaatggtatttcaacttctacagcaaatcatgacttcttctcaggtgttggaaatggttatttattgggtgaagttgaagcaatgaatgatgatgattataatattggattagactaaaaaagaatcgcaattgcgattctttttttatttaaacttcatcatgtgagaagaaggatagtgatgtaagaagttttgctaatactgggtacaacttcccagcaaatataatccaagcgtatgcaaacaagacagcagctattgtatcacttaagtaatgtgcgttaaagtatattcgtgacattaaagtcattacgccaataacagttattgcccaagaaattaagaactgttttcgtggcgattcgatgttaggaataacaagcaaggaaaggatgaatatgactgaaaatataccaaacacatgactgctagggaatgaggagccttggtcgctgagtaaatgaccaactggacggctcctatcgacgctaagtcgaataatggcattgaaaatatttcctagaataattgtggtaaccgcccaaatggctggaatacgcaaattagcaagtagtaggatggccgctagaatcaacacataaatgacatcaaggatgggtgaacctagaaaggaaaatacagtcatcaagatatcatttagaccagtttgaatgcctgccatgaatgaatgaatgctattatcaatgatggttggaaatataaactttattttgacaaaaacactaataataagggcagatataaagcagataatcgcataacgcaattgcttattttttacggaaataatcattgtactgatctccagaaagagtttttttaactccttctagtataagggattcgctatagaaattacaatactatcatttctgcaatgcacaatctttatcttccaacgatggaaaattagttgcctttataatctggggctaatttgtttacgggtggagtgaacttacgcatcgattcagctagatgtacaaaatttgttactaaatgttggttaggtgcattaacaccgtttttatcagccaagtctgcaatccaaccgttaatatagtccacttcagttgggcgtcccttgacaaaatcctgatacattgatgggaaatgaagcgggttaccaatatttgaaacataatcaacctgcttgaccatttcatcgcgtgtttcaattagtgtaatgcctgctgcctcagcagcatcgtaagcttcattaattaatgggcgagcaataccttcaaggaagttatcgtaggccattagctgacccattcgtgactgaaacattgtggcgatggaattttcaactgcgttgaaaaatactttagtcaatagtgtacccataaagttttccgtataagaggggtttaagtgcgctgccttgaaatcttcttggatcttatccataaccgttgatggtttttcggttagattagcataaacagagctacccatactttctccgcccatgaaatcaacgtcgccgtaatcatttaagacggtggcgatcattgctgtaccaccaataatgtgttcatcatcaaaatatttttgcaacttttcaatatgacccatgccgttcattgcaccgagggcggtctgtccaggtttgaattttggcgaaagacgatccaaggtatcttggagttgcatttgcttcatgaagaaaatccaaacatcagggctaccttcatattcttcaggagaaaaaatgttaattttaatttcgtgacggtctttgtgatcacgggatttccaaactttatcaccttgttcgtgaatcttatcgaggcttgcttgcgttggttcgacaaaatcaacggggacaccggcattttcctgaagcaaaatgccgtaacgaagacccattgcaccggcaccaacaactgtgtatttcataattataataacctccaaagacttgatgagataatactaatccttttatcacaaaaagtcaatgtgatggatgtatcaaatgggaactttattgacatcatgatggcgtttttaatttaaagtaatcaattagcaaatcatataacgttcatttagcctagctgatataatattaatgtatgcatatcgtatacttaaacaatcaacaatatatcgctcaaagtgtgcacgcaacaacaatagtttcattattgtgtgtgtatattttgttacgtcacacattaaagtcactgcgcaataaaagcttttcatggcggggtctactggggcgggctattctctcggtatatgcaacgttggttgctgcttttacactaaccttttataaatggccatcatttgcaacatatttggcagtgataaaaggatatggcgattttggtcagtactcattcgtccatttatcgctgtttaatgcagataatgttgccctcagctggtaccagatgactggtaattttatgttactgctgccgttagggtttatagctccgttcttatttccaaaatggcggggattgcttcgtattgtgccaagaatatttttaacaacgttaactattgaaatcattcagggaactagcacattcttttatctttcaaatcgtatctttgatatgaatgatcttgctgtaaacacagctgggggtgtggtgggctatgttatctatctgataacaattttcgttatgaaaaaagataaaaattttgttccaaaccatgttgagaaaggcaatttaaatgagcacaatctttatattaagtcttaatcttatatgtatttattttttcttttggctaattaaaccaataaactttgccagatttatgccatatacaccgcgtcaagcagcttttttgaaagtggtactctccatcataggaggatatcttttggctagcttttttgtttcagcaacaaattgggttattcaaataccaagcacaatattgggaaattagcttttttaaattattaaagatatttttagttgagcatcccacttgtatgagaatcaagcgtaaaaaggtctttacaatatgttataatttaatagattgtatatgaaaataattaacattaataaaagttaaagtctcggagacatgaaatggcaaaagatattggaattgatttaggaacagccaatgttctcatttacgtagaaggaaaaggtattgtactaaacgaaccgtcagttgttgcggttgatgataaaacagatcgagttttggctgtgggatcagaagcttatcgtatggtaggacgcacaccaggtaatattcgtgcggtgcgaccacttaaagatggtgttatttcggattttgatgtcacagaagcaatgctaacctattttgttgacaaacttaacgttaaaggattcatgtcgaagcctaacattatgatttgcgcacctactaatatcacagagattgaacgtaaagcgattatacaggctgctgaaaaagcaggtggtgcaaaggtttatcttgagtatgaacctaaagttgctgcagttggtgcaggactggatattttcaagccaattggttcaatggtgattgacatgggtggtggtacctctgatattgccgtattatcattaggagacattgttgtttctgagtccattcgaattgccggtgacaaaatgaattttgatattgttaacttcttaaagcgccgtcacaatttaattgttggtgagcgtactgcggaaacaatcaaaattcaaatcggttcggcgctgcaggctgatgaaccattaacaatggaagtgcgtggccgtgataattttgagggtatgcctaaaactgtaacgatcaactcaaacgaagttgaagattcattacatgatacgttgcaacaaattgttcgtgctgcacattccgttttggctaaattaccacctgaattagcatctgacattattgaccgtggtatcatgctgactggtggtggcgcattactgcatggcatggatcaattactttcagatgcactggaagtaccggtggtagtatcagattcaccgctagataatgttgctaaaggagcaggagccctacttgaacacatgaaatcagggcgccgaggattataatgagaagaaaaaatcagaactttgacgttgaattaattgtaaatgaccaacaaacacaagttttagttgataagaaacaaattggatacattgaaaaagctgatcgtggttttgttggattttttggtcaacaagcgattattaatcaagccaaagacgaagacgaagccttgcaagctatcttggcaagctttaatctaaatcactaaaaataaggcacgttgtgactaatcatgacgtgctttgtacataatttttttaaagaaataaagcggcttaacaaaatcgaattgatatttttttctttcagtgtgccgttttatatactggagatgctatgcaacagacacgacaaacttcaagacgaacatctggatcagagcttgattggggaatcattttagctttgttgctatttatgattatcggcttgagttcattatatgaagcagcgacacatatgcagggtgcgacaaccttaagtgctgtaaaagtagtgatgaaccagggcatattctggtttataggcgtattattaattgtttttttagtcaggtttgacggatcacaattgtggaaattagcacctattacctatggattaggcatctttttgttagtagcagtgctaatattttataatcgagcaatgtatgattctacgggtgctagatcatggtttgtaattggccccttatcattccaaccttctgaagttgttaaaccggcgttcattttgatgctgagccgtgtggttgcgcagcataatagaaattatccgaatcatgcactatcaacagactggttgttgttaggtaaaatggcggtttgttttatacctgttgcggcattaattgctttgcaaaatgatttgggaactttattggttttcgttgctatttttggtggtgttgcactggtttctggggtaacctggcgaatccttgctccggtaattattttgggtgcgaccgttggcacaacgttgttaactttggttatttcttcagctggtcggactatattgagcaagttgggattccaatcttatcaattttctcgtattgatacatggttaaaccccgcaaatgatacgtcagggaatggatatcaaacttatcaaagtttaaaagctataggttctggtcaattgacaggcaatggatggggaagtcttaaggtgtatgtacctgtgcgcgaatcagacatgattttttccgttattggtgaaagttttggctttataggtggtgcgttcctaatagcgttatatttcggtttaatttatttattaattcgtgccacttttagagcacaaagtgccttttatgcctacattgccactggtgttgtaatgatggtattgtttcacgtctttgaaaacattggtatgagtattggattattaccactgacaggtattccattaccgtttgtttcacaaggtggttcctcattgttaggaaacatgattggtgtaggattgattctttctataggttaccagcgtcaaaatagcacgtttacagaaacgacaggtttttttatttgatgatagaattagatgaattaaaaaaagaatttataacattgcgtcaaaaggtgcgtaatggggatgtgttccaatcattaggagaattaatgaaggaatcactacataaaatgcccccgcaatctttaacaactgtgtcgttgcctgttgatggtgaatttgcgttaaaacgtatgcagaactatacgcaacgggcagatcaaatgaccgaatcagaaacagcgacggaagattttgactttcaagtgaaggacgcagatttggcgttgattgttgaacagttagctagtccgttgccaaagtatcgagatacgggagcattctttttcttaagtgatatgattcaaaatgatttgctttcagaggagcaattgcgttggctaacagattatcttgtttcggatgagcaattattcgctcatatcttagaaccacagaatgacgccatttatcgccgttcctttagtgtgttagttttatctttgttattattttcaaaccgtataaaaacaccttttatgtctgagacgcaattaaatcatgttatcgatcaagttgcattgtatgccgctttggaacgtgatggacgtggctttattgatgaaaatggttgggcgcatgcttttacgcatattggaaacgctgtcgcagagatcttcttaatgcctgatttagtaagggccgataaggtatttgttctgggtgctgttctcgctggttatcatgaattatcacagccgttgacttttggcgaaacagaacgtttggtagaagtgattacccatatctccaagcaacatgagttgtatgcagattatctattattaactttaaaaatgtggcgaaaagatttagtgacccaaacgccaccaaagacacaacaacaatggcaacaattgtataaccgatcacagtttttccatgaaattttgctacgtggaaaaaatgaagtaccagaggcggtatttgattatgtgagcgttacaaaaaactatttagcataataatttaaaatgtttattgcacatacaaggtgaggacggaaagatgactaaaaaaagagtagcgcttatttttggaggtaattcctctgagcacgacgtatcaaagcgttcagcgcaaaatttctataatgcaatcgaagcaactggtaaatatgaaattattgtttttgcaattgcccaaaatggtttctttttagatacggaaagttctaagaaaatacttgcgttagaagatgaacagcccattgtggacgccttcatgaaaactgtcgatactagtgatccattggcgcgcattcatgctttaaagagtgcgggtgactttgatattttcttccctgtagttcatggtaacttaggagaagatggtacactgcaaggtttatttaaactattagataaaccatatgtgggggcaccgttacgtggccatgcggtaagctttgacaaagctttgactaaagaactattgacggtaaatggtattcgcaatactaaatacattgtggtggaccctgagtcagcaaacaattggtcgtgggataagattgtggctgaattaggcaacattgtgtttgttaaagctgctaatcaaggatcttcagtgggaatttcacgtgtaaccaatgccgaagaatatactgaagcattatcagattcattccaatatgattataaagttttgatagaagaagcagtcaacggtgcccgagagttggaagttggtgtgattggtaacgatcagccgcttgtctctgagattggcgcacatacagtgccaaatcagggtagtggggacggttggtatgattataataataagttcgttgataattccgctgttcactttgaaattcctgctcagttatccccagaagtaacaaaagaagttaaacaaatggctttagatgcttataaagtattgaatttacgtggcgaagcgcgaatggattttttgttagatgaaaataatgttccctacttaggtgaaccaaacacgttaccagggttcacgaatatgtcgttatttaaacgtttgtgggattattctgatattaacaacgccaagctagttgatatgttgattgactacgggtttgaagattttgcacaaaataaaaaattgagttactcatttgtgtcacttggagaagaaaagatagggaagtttaactaatagaatttagtattagtagcatttccacttagatttatttaaaaaatttattaataaatactttagccctgcaatggagaagttcatggtacaagtaatttcacaaaatgaacatcgtcgtcaacagattattgaagcggcgacaacaatctttttatcaaagggttttgagcaaacaacaacgcgagatatagcaaagaaagtaaacattagccaacccgctttgtatcatcattttggtgataaggagtcattatttgttgaagtaatttcacgtgttggcgagtcgacctatacggatatgcaaagtattttatcacaaacgtatgctgaaccaatcgatcaactggttgatttaacacaggttattgtacttcggcatccacgtgatgtatttagattaatacatgacagttttgattcattatcagcaacgcatcgaagtaaactgggcatgatttttggacgggattacgtcggtccaattgcacaattttttgaaagtatacagttgcgtgataatgttgatgcacaaatagctagctcattttacattactagcttatcgccactgtttggtgaatttcattcactgggtgaacaaataacaatgcgtgaaagaattcaacaattgttggacctcattttatatggggtagaaaaaaaatagtatcaatggtatgatactagaagaatatggaggctgtccgatggctagtcacaaagtatcattagcgtgcacagtttgtggatcacgcaattacacagtaacattatcaaaagatcgaacagaacgtttgtcagtaagtaagttttgtcaacactgtggcaagcatacattacatcaacaaacaaaataagggattcaaaatgattaactattttaaaaacgttgcacaggaaatgaaaaatgtcacttggttaacaggtgaacagacatctaaggaaacaattacagttattactgtatcgattatttttgcgttgttcttaggtggcgtagattggctattgcaacaaggatttaacttcttactggcgaaatagttttttttttgatatactaataattactgataccaaggactctgatgggttcttttttattttgaaaaggggtaaacaatgtctgaagaaattgaaaaatcatggttcgttgtgcatacatattcagggtatgagcacaaggttaaggctaacctagaatcacgtacacaaacaatgggaatgtcagagcaaatattccgtatcttggttcccgaacaagaagttacaacaatccaagacggtgaagctaagcaaactgttgaaaacgactttccaggttatgtattagtagaaatggcgacgccatatgaagataatatgacagacgaggcttggtatgttgtccgtaacacaccaggtgttactggtttcttaggctcccatggtgccggatcaaagccaaattctttgcttcctgaagaagtcgatttgcttatgaagcgtatgggtatggttacacgtgagcaagttgatttggatgttgcagtaggacaaacagttaagattatctctggaccgttttctggtatggaaggcgtagtaacctctattgatcaagaaaagcaaactttggaagctactgtagcagtgtttggacgtgaaacaccaacagaactagacttttcagatgttgatacaacgctagattctttataattagaaaagacgactaaaagcattgagtttttggttgttttctgttatgatactatggtatgtcattgacatgcgtgggagcagcactaaagctgtgtttcaccacaacacgaggaggaaaatatcgtggctaaaaaagttgtaaatgtagttaagctacaaattgccgccgctaaagcaacgccggcaccaccagttggacccgcattgggacaagctggtattaacattgcgcaattcaccaaagaatttaatgcgcgtactgcagaccaagctggatcaattattccagttgaaatctctgtttttgatgaccgttcattcgaattcgtcacaaagacaccacctgcagctgatcaattacgtaagattgttggtaagggttcaggtgaacctaacacaaagaaggctggaaacgttactcttgaccaaatccgtgctattgcggaaaacaagatggctgacttgaatgctaacgatattacaaacgctatgcgtatgatcgaaggtacagcacgctcaatgggtgtaactgttgacggtgttgacttgactgttgaaggtacagcaatcaaggaggacgcagaataatgactcaaaagcatggtaaaaattatgtagcagcagttgcaaaggtagaagctgaaaaagcttatgctttaaacgatgctgtttcattggtaaaagaaattgactttgctaagttcgatgcttctgttgaagtagttttcaagttgaacgttgacacacgtcaagcagaccaacaattgcgtggtgctgttgtgttgccaaacggaacaggtaaagataagacagtcgttgtcttcgcgcaaggcgataaggctaaagaagccgaagctgctggtgccgatgttgtcggtgctgctgatttggtacaacgtatccaaggtggatggttagactttgatgtagctgttgctacacctgatatgatggctcaagtcggtcgcgtaggtcgtgcattgggtcctaagggattgatgccaaaccctaagactggaacagttacaatggacgttactaaggctgtttcagatgccaagggcggacaagtaacataccgtacagatcgtgacggaaacgtcgcagttcctgttggtcgtgtatcatttgaagaaggtaagttggctgaaaatattaagtcaatcgccgaaacagttcttaaggctcgccctgctgctgttaagggtacttacgtacaacacgtgtcaatttcatcaacatttggtccagccgtaacgttggatattaatacattgtaatttgacattatcaacttcgtttggtaaaatttattaagtaattgaatccattttgcctaagactcaggtgatgcttgcatcttaatatcctgccgaggaagtttaaaaaaacttttcccgtgtgtcttctagcgcacgggatttcttttgcaaaataaatttaaagaaaggagatatatcattatgagtgaaaaagctattgcagttaaagcacaaaaagttgaagaaattgctgaccaatttaaggcagctgcttctgccgttgttgttgatcctcgtggattgacagttgctcagtctactgaattacgtcatcaattgcgtgaagaaggtgttgttcttgaagttatcaagaacaaagttttgacacgtgctgctgagaaagctggttacgctgaattgaacgacatctttgccggaccttcagcagttgccttttcaaacgatgatgcagttgcaccagcacgtatcttgaaaaagtttgctgatgaaaacgaagccttggaaatcaagggtggtgtcgttgacggcactatcgctaatatcgatgacattaacaagtatgcatcattgccttcacgtgaaggtttgcttggtcaattgatggcagaattccaattctcaattcgttcatttgcatatgctgttaaggcagtgcaagacaagttggaagaagaatctgcagctcctgctgcagaagcatcaacggatgctgaataatatttaactaaaaaaacataaaaaatcatttggaggatttagatcatggcttttgataaagacgcgatcatcgcatcattgaaggatgcaacgatcttggacttggctgacttggtttcagctatcgaagaagaatttaacgtttcagcagcagctccagtagcagctgctggtgctgctgacggtgctgccgcagcaaagtcagaatttgacgtagaattgacttcagcaggtactgctaaggttaaggttatcaaggcagttcgtgaagcaactggcttgggcttgaaggaagctaaagacttagttgacaacgcaccttcagttgttaaagaaggcttgagtgaagacgatgccaacgcattgaaggaatctttggaagcaactggtgcttcagttactgtgaagtaatctttctcaacataaaaaaaggagtacttttgtacttctttttttgtacataatacatattataggcagctattattttaatctaaaggagctagtacaatgacagaaaagaacatttctggagaacagtattttacagctaatcccaacgcagaacatcattatcaaaattttgattttgacttgctagggcatgaattgcattttacaacggatagtggcgtgttttcaaaatctaccgttgattttgggacaagaacaatgttggatgctttagaaaaaacaagtatacctattgggaaggtactggatttaggaacaggttatggtcctgtaggtcttactgtggcaaaagcatatcagcgtcatgtagatatggttgatgttaatgaaagagcgttagatttagcacgcaaaaatgcccaacaaaacggtgttgctcaacgagtgaatatttttaagtcggatgtttacgcaagtattagtgataaatatgcactgattttggttaatccaccaattcgcgctggaaagcaagttgtgactgcaatgcttcaagaaggagctaactatttacaagatggcggaaagctaattgcggtgttgcaaaagaagcaaggcgcaccttcggctcaaaaaaatatgtcacttgcttttggtaatgctaaggtgattcataaaaacaagggatattacattttggagagcacttatggcacaaataccagcatttagtgacgaacaaattgattatttcatgcaagaggcgttgaacgaagctaaaattgctcaaagtgaaggtgaagtgccaattggtgctgttatagtttatgaaaaccagatgattgcgcgtgcgcacaatcatcgggaggcggatcagttagccactgcccatgcagaattactagcaatcgagtctgccaatacaaagcttaagtcttggcggttagaaaacacagcattatttgtgacgttagaaccttgcatcatgtgtgctggcgcaattattaatgcacgcattccggttgtttattatggtgctaatgaccctaaaggtggtgctacgcgctccctatattctctattagaggataatcggttgaatcatatggttaaagtgtacgaaggcatacgtggtgaagaatctggtctattattgcagcgtttctttagcaacatccgtgcgaaacgtaaaattcgtaaagcaattgcaaagtaaataattgctatttaacataaaaaaagtttataatagcatgtagaaaataaaagaggcaaatgaatgcaaaatccgaacgcatggcgtactgataaggactatataaatattattgatgatttgttacagcatgaagaagtgcaacaactggcactctatacacaacatcatttttctaaccgtttaactcattcaatttctgtatcataccaatcatatttaatcgcaaagaagattggtgctgatgaagtggcaactgcacgagcaggtttacttcatgatttgttttactatgattggcgcgtaacaaagtttgacgagggatcacatgcttatgttcatccacgtattgcgttgaaaaatgcgcgtaaaattacaaatatcagcgataaagaagctgatattattgtaaaacacatgtttggtgcaacaattgccttaccaaagtatcgggaaagttggattgtttcattggttgatgattttgcggcagttaatgaatacctaattcctaaaacttatctgacttattttaagtggcaagaaaaattggcaacgaaatttgtatctgtatttgcttaaagtcacaaaattagatataatataaaagcaggcaaatgtcggctctcgaaccgggtcaggacaggaatgtagcagccctaaggttgttcgatgttgtgcttgtgtacataagtggccgcttagcggtctttttttataaaaacaaatgttataaatcggtggttttatgcaaactaagaaccccaatatgatataaaacatatagccgacaagtagcaccaaacatgtttaccaatgatatatggaggtgatgaaattggcatatcaagcattgtatcgcgtctatcgaccacgttcttttgatgacatggttggtcaaaaaatcattacacagacgctaaaaaatgcaatagcgacgcaacaaacagggcatgcgtatctatttagtggtcctcgtggaactggtaagacatcagctgctaaaatttttgcacgtgaagttaatggtatagcgccggaaactgatgattcacaaattcctgatattattgaaatagacgctgcctcaaataacggtgttgacgaaattcgaaacattcgagacggggcaaattatgcgccaatagaatctgaatataaaatttatattattgacgaggttcacatgttatcctcgggcgcttttaatgcactattgaaaacattagaagaaccgccagctaacgttaagtttattttagcaacgacggagccacaaaaaataccagcaactattttatctcggacgcagagatttgaatttaaacgcattgataatgacactattcaagctaggatggctgaaattctgcaaaaagagagcgtctcgtttgacgacgatgcacttcatattattgcaaatgttgcagaaggtgggatgcgtgacgctttgtcaattttggaccaagtgttagcttttggcgctgatcatgtaacgcttgaaaatgctttgcaagttaccggatccacaacagcatcacagttagtgacctatttgcagcaagtaagtaattacgatacagaatctgcccttcagacactacacgatatattgttagagggaaaagatgcagtacgttttgtagcagatttgttaggtgtgttgcgtgatgtgatgttagcggaagttgccccaaatttaattaaaacgacggcaccattggctgatttgaaggccttaacaattaagttgggtacttcccgtattcagcaaatgatggtcactttggatgatattcaaaaacagttgttacagactatgcagagtgatgtatatttggagctactcactgttaagctgtctatgccagaacctcaacaaactgtacctgcaaaacaatcctccaatgtgattaaagaaaaacctcaaaatattgatgatattgttaaagcgtcaaaaaatacagaagttcatgaggaacaagttgttgaaccagcaatagaaaaaacacccgtagaagtgcctgctgtagagaatgctgaatacgaggatttgttagtgcgtactggacaaaatgcagtatttgcagtcttaattgctgcgaaacgtgatgccttagcacgagttaaaaacgcttggtccgacttattgcgacaatttaatgttacgcaacaggcaatgctgaccatagccgaacccgttgcagcaagtgaacaggctgtagtcttggcttttgattatcctgtgttattagaacaggcgctacacgatgctacattacaaaaccacttggtgcagcaactacaatcacagaatttaccaagcgaactagtgtttatttcacaagacgaatggacctctgatcgtgcatcgtatgtgaataaattaaaaactggcgaaacacctcaaattcaattagaagatgtgcctcgagtgaaagctgcccatttatcagcgattcctacaaaaactccgcaagaatcaagcaataaggagttaaaaattgttagtgaggctaaagaattattcggcgaggatctcgtgaatatcgttgactgattaatataggaaggaaatatgtttaacgcagtgcgcgtgaggcattttgaaaatatgcaataccctgaacctatcgctaaattaatagatagttacacgaagttacctggcattggtcccaaaacggccacaaggctagctttttatacattaggtatgaatgaagaagatgtgcaggatttttctaaggcattgatttccgcaaaaactgatttaactttctgctctatttgtggtaatattactgcaactgataccgatccatgcgttatttgtcgcgatcaatcacgtgatcagtcaactgtttttgttgtcgaaaattcacgtgatgtaatggcgatggagaatacgcgagattatcacggcctatatcatgttttaaatggtgttatttctcctagcgcaggaacaggaccagaggatattaatttaccaagtttgattcgacgtttgtctgagcatgaagaaattaaagaagtaattgtcggcactaacgcgaatgctgaaggagaagctactgctatgtatttagcacgtttactgaaaccggctggtatcgcagttacccgtttagcacatggtttagctgttggatctgatattgattatgctgatgaactaacactcattaaagcagtacaaggacggacaaaattatgatatttggcaagaaaaaaactggattgcgcaaagagtatgatagagcacttgtatttcaaattgataaagcaaaaattgactgggatacggcaagaaactctgaagcagcattacttgatggtcaagtaaatttacggctcatacaagcgcaaacggcactggcacgtgctaaatttaattatttatatcgtgaagcacgtcgtcgtaaaacagttgggcacatgcaaacccatgttttaaaaacagatcgtatttaatcattagacaaattactcataaggactgttatgccaaaaccaatatttatatcattcgaaggacctgagggcgctggaaaaacaagtgttcttgaggcattgatttcagaactaaaaactaaacttggcgataatttggtaactacacgtgagccaggtgggaatccaatttctgaagcaattagatcgattttacagccagaagaagataatggcatggataaacgaactgaggcgctcttatatacagctgctcgacgtcaacatctcgtggaaaatattaaaccagcattagatcaaaacaaaattgtgatatctgaccgctatgttgatagctcacttgcttatcaagggggcggtcgtggcctagggatcgacaatatttgggaaattaatcaattcgcaattgatggtctattgcccgatatgacaatttatcttgatgtgcctgttgaaattggtttggcacgcgtaaatgagaatcgtcagggtaaaattgatcgactagataaagagagtatttcctttcatcagaaggttcgagagacatatttaaaacttcaaagtgaattttctgatagaattaagatagtagatgctacgcaaccacttaacaaagtcattgatgacacgcggatactcatcaaccaaattctggaggacaaatcatgaaattagttacagcaattgtgcaagataaagatacaacaaaactcagtaatgcttttgtgaaggcaaatattcgtgcgacacgtttagccacatcaggtggtttcttaagatcaggaaacacaacgtttatgattgccattgaagatgaacgagtaccagatgttatggaaattattaaaaaggtttcacagaaacgtaagcaatttatggtgccacctatcagcctggatgctagtggtgaccacgcgggtgcttatccaattgaaattgaagttggtggtgcgacggtatttactcagagtattgattcatttgaacagttctgatgttaccagattttgcaacaattgcacaaaaaaattatccagcgcaactcgctcattttaatgatttactgcaacaagataagttgagtcatttatatttgtttgttggtccaagccagtccgcaaaactggctttttcgcgttatatagcttggcaagttgttcatgctgatgaacgcaatgccttacgaattactgagaatgaacatccagacgtacatatcacagcgcctattccgccagctacttcactaaaagtggctcaaattcgtgatttaacacctgaatttgtaacaacagccactgaaagtccacggaaaatatttattttagatgcggttgaaacactcacagcaagcgcagcaaattccttgttaaaattcattgaggagcctgctggaccacaattaattatgatgcttacggaaaacatgtccgatgttttaccgacgattagatcgcgcgcgcaagtagttcagttagcatcagctattgccagtgatgatgatgatttaatggacggtgattggcaaaagcagacccaattagtattgtttaaatggtttgagcttatgatgcagagacgaattgaagcatttgcatttgtgcagacaaagattattagtcaattaaacgacacgaagcaacagcagttatttttaaattggttacatgagttggccagagatacaattgtttatggccagattcccgatgaacgattagcttttcccaatctaattgggctatataaaacattacgacagcgctatgatatgtatcgattggttaaagcaagtgatgaagtatttgctgacgataaattgcgtaaagtgaacctatcgttacaagcacggttagaaaaaatgacactagacgtcataatcgctctgggggaataaaatgcagcaacaaaaaagttttgaaaatcaagagacaggaacactttttttagttccaacacctattggtaatttgcaagatatgtcgccaagagctattgatacattgcgcgatgtagatataattgctgctgaagatacacgccacacacaacagttactaaatcattttgcaatcacgacaaaacaaactagtttccatgaacacaattggcaggcgaaaatccctggccttattgcagatttacgaaatggaaaaaatgtagcacaagttagtgatgcggggatgccttctatttctgacccaggtaaagaattagttgcggcagctgtggctgaaaacttagccgtcgtaccgattcctggtgcaacggctggtgtgacagcattgattgccagtggtttagtgccgcaaccgttttatttttatgggttcttacaacgtaaaaatagtgaacaattggcagaattacagcagttatccacgatgcgggatacagtcattttttatgaatcaccacatcgattaaagcaaactctagtaaatatccaaaaagtaatgggtgatgagcgtcgtattgttttagcacgagagctaacaaaacgctatgaagaatttattcgtggaactattgatgaactagtttcgtggtcgcaatcaaatgaaattcgtggtgagtttgtagtaatgattgatggctttcatggagaaatttctgaaccagataacagtattgcactgactgtccaagaagcagtatcagcactgattaaaaagggcttaaagcctaacgcagcaataaaacaaatagcaaaggaacgaggccttgatagacaagcagtatatgcggactatcacgagatagagtagtatgaaaaagtatgaaataaaaagacgtgttgaatattatgaagctgatacaacacaaaaattatctttaccaatgattttaaattatgctgtcttagcgtctaaatgtcagagtgatgaacttggcgtggggcaggacttccatgtaggtcgtggccttggctggatcatcttacaatatgaagtaataattaagcgacgtcctaaaattggtgaaataattcgtattcagacctttgctacacaatacaatcctttttttgttcgtcgaccattcgtctttttagatgaaaatgataatgaaattattcgtgttgattctatttggactatgatagatatgacaaatcgtcgcatggcacgtttaccacaagatataattgatcagtatgatgccaaaagagttaagcaaatttcacgaatccctaatcctgagaagttttcagatgatgatcaatatactgaaagggactatcatgtgcgatacttagatattgatggtaataagcatgtgaacaactcgaagtattttgaatggatgcaggacgttatcgcaccagagtatttgttaacccatgaaatcacatacattaatctaaaattcgaaaatgaaattcggcttggacacacgattttatcgcaagtagttcaaaatgataataaatccaaacatcgcattatgatggaaaatgtaataagtgcagaagcagagttcaagtggcggaaaatttgatataatagtgtgtagaggaaaaaaagatatggctattttagttcttggtggagccggttatattggttcacacatggttaagcgtttgatagaagcggatcgcgacgtcgttgttgttgatgcattgtttacggggcaccgcgaagcggttaatccaaaagcaaaattttatcaagttgatattcgtgataagacagcattgtcggaagtgtttgacaaagaaaatatcgaacaagttgttcactttgcagccttttcaattgttccagaatctgtagcaaacccactaaagtactttgataataatactagtggtatgattactttgctagaagtgatgaaagaacacgatgttaaacaaattgtgttctcgtcaacggcagctacttatggtaatcctattaatattcctattaaagaaacagatccgcaacgaccaattaatccttatggtgagtcaaagttaatgatggaaaaaatcatggcttggtctgatcaagcggatggtgttaagtgggttgcattgcgctactttaacgtagctggtgctgccgaagatggtacaattggagaagatcacgcgcctgaaacacatttagtaccaattattttgcaagccggtttaggtcaacgtgaatatattgagatgtttggtgatgattacaatactcctgacggtttcaatgttcgtgattatgtccatgtgttggatttggctgatgctcatattttggcattgaagtatttagccgatggaaacgattcaaaccaatttaacttgggatctgctactggattctctgttaaagaaatggtagaagcagctagatcagctactggtgttgatattcccgccaagattggtccccgccgagctggtgaccccgatattctgattgctaattcagacaaagcacgtgatgtgcttggctgggctcctaagtatgataatgtacaagatattatcaaaacagcctggaattggcacaaaaaccatccatcaggatataatgacaagtaacataattcttaaatataatcctatcaagagaagtgattctaagttatttagaatcttccttgataggatttttttatttattcgaaaataagatgagtttattgtaatttaaaattaatgattgattaatctaaaaggaagtaatatacttgtaagtacgtaaaaaattacaatttaaagataaacgagaaataaatatgcaaatgttatctgaaatagctggaaaagggacttacatcattagagaattgactggtagccggcgcttaaccaaacgactagcagagatagggattaaagcggggaaaagtattgaagtaatttctttgcctgatcatacttcagggttgattatctattttcaagggcagcgtttagcggtgagcaatgatattgctaatcaaattagtgtagcaccagtcagtgaaattaccacggatcattttaaaacgttatccgatatgcccatcaataaaccaggcgtagtagccaaaatacttggtaataaagcattgcgtaagcgcttgatggatatgggcattacaaaaaataccgttgttaaaattgaccgtgtagcgcctttaggagacccgatagagttggttgtcaggggctataagttaagcttaagaaaaagtgacgcacaactagtagtattaacagagatttagtctatgaataaacaatgtacagtagccttagcaggtaacccaaacagtgggaaaacaacactctttaatttattaacaggttcgcatcaacacattgggaattggccaggcgttacagttgaaaaaaaatcaggtcgtttaaaaaataatcctgacatcattattcaagatttacctggaacttattccttatcagcatatagtccagaggaagtaatcactcgtaactttttaattaatgataaacctgaacagatcatcaatgtgctcgatgctacaaatattgaacgtaatctttattttagtttgcaattaatggaaactggtgtcccaattattttggctttgaatatgttggatttactagtaaagcaaaggcaatatcgaattgataccaaaaaattatcttatttgcttaatgtaccggttgttagtattagtgcgttaaaaaagaaaaatatcaatcagctgactaaacaggttattgctaacactgaccagccacaaacctatccacatccagtttatgataagcggttggaatcggcattatccatgattgaagaacagattgatggcattatcgaagcagatcagttgcgatggtatgcgattaagctctttgagcgtgatgaagcagttggaaatttaaaattaacggcacagcagcaaactgaaattgacaatataattgatacggcagaaaaattatttaatgatgacagtgatagcatagttgttaatgcacgctatgactatatagaacgcatcataaacatgtgtgtagtacgaacaagtgatttttcaatgagtatgagtgatcgtgttgatatggtagtcactaaccggattcttgcattacctatttttatatttgtcatgtggattgtgtatttcttatcgatccaaaccattggaacaataggaagtgattgggtgaatgatgtattatttggggactttattccgaatagtgctaatgcaattttaacgtatttgcatgtttcagtatggttgaagagtttaattattgacggtcttattaatggtattgggtctgtgttaggtttcttaccacaaattatgatgctctttttgtgcttaagtattctagaagactgtggttacatggcgcgaattgcgtttgttatggaccgcatttttcatcgttttaatctttcagggaaatcattcatccccatgttaatttcaacaggctgtggtgtaccaggcatcatgtcgacacgaacgattgaaagtaaaagtgatcgtcgtatgacaattatgttaacgacttttatgccatgttcagctaagttaaccgtgattgccttagttagcggaacattttttccagaaaattcatgggtagcaccaacctcttattttattagtattttgacagttgttggctcaggtatttttttgaaaaaaacaaagctcttttcagaaccgccaacgccatttgtaatggaactgcctgcttatcatttgcctagtattggtaacgttagccacagtgtgtggattaaagcacatgcctttatcaaaaaagcagggactataatttttgcgtcatgtgttgccatctggtttttgtccaatttcaattttcactttcaaatggtcgatcaaaacgacagtatcttaagagacataggtatggttatagcacctatttttgcaccattaggatttggtgactggcatgcgaccgttgcagtgattgctggtctaattgctaaggaaaattgtgttagcacattaaacattacttttggttcatcaagcactgcctcatttatgagcaccttaagacaaacttattcccccatggcgggttattcgtttcttgtctttaacttattatgtgcaccttgttttgctgccatcggtgctatgtataaagaatttggtgatgcactttggacttggcgcgcggtaatctatcaaaccgttgtggcttatatgtgtgcgctcagtatttttcaagtgagtgaaatcattcaaggtaatgtttcggtgtactttgttgcgttatcgttcatcgctattgggttgatgctatatggtatttttatcaaacgtgagcgcccgcaacaactagaattgtattagaaaggtcagtcaatatgtcaacatttatcatagctgctattatttttatcttgtttgcgttggtcatatacaataaattttttaagaaaaatgctagtggtagttgtcatgattgtgtcgacattggttgtccgcttgccgatcaatcaaaaatgttaagaaacaaaaaaagcaatcattaaaacacgaaaccccgatgaactaacgcgttcatcggggattttttattatgagagaatatttgagagagaagagaatagtatattcgggagagaatataagtttatttatagtcgcggggagagcgcgacttggctcccttttaccatggggtttcgtgtttctgatgtgatcgccatcagtcatactgcttatatattttagtcctccaaaaatttagattttttatttgttatattttaattcaactaggcttgttgtttgagataacttgctttgttgatgtttataatataacgttctaaaattaaattcatgtaaactgaagataaagtgaacattaaatgattatttctctgttgaatcacgcacaacgagttcaccatctaacacagtacgtatagtgttagatgggttggtatcgcgtacagtacaaaacagttcataaatttttttcccagtttggtaaaaatcatattcaaagctagttaagtttggtgtaacggtcgtacttaaatcggatctaccaaatccaatatattgggcattttgtccagctgctaaaccagcttgaagagcaccgattgtgatgcgatcagtcgcgccaataattaaatcaaaattttgggactgcatcgcttgttgtgcggctacttttgcttctgctatgctgaactttgaatcaacgacagtcaccttgctagttgacagtttttttctaatattgagaaaacgatcatgaccaatggcccaatccattgtttcatcaatttttaacagtaaagtattttgaggatgcagtgatgcagcaaattcaccgacaacagttccggcttgcagatcgttcatgactacgcgatgaaagttaggttcttcttgtccttgaataactactggtgcatcaaattcagttaatgcgttacgtaactcgtcgtttaaattagctgttaaaacaatcaagccaccaacattttgtgtacgtaatttttcaatagcagcgagctcacgtttagtcgattgataggtattgacgatcaagaaagtatcattttcgtttgcatcatctagcccacggagcatttcaacttgggcggatgaatcgatccgaggcacaatcacacctatcgtgtgattgactttctgttttaaactttgcgcaaaggtattgggctggtaattattttcggtaacaactttgtttattttttcacgtgttttagcactgaccggtccgccattcaaatagcgggagacagtgctttttgctacttgagccatattagcaatatcagttattgtcaattttttttccatagacacatattaccatgaacgcaatgaaagcgttgtcattaacttgtaatatttaacttaaaaaggaggttgcaattatttttgaaagcggttacaattagtttataaataaatggaaacggttccaaaaaacttaaagaaatttagaggagcagcaaaatggatcataataaagtagcaaagcgtattgccgatgctgtcggcaaggacaatattgtagccgctgcacattgtgctacgcgtttacgattggtgatcaaagatgttaaaaagatcgatcaggatgccttggacaacgattccgatcttaaaggaacatttaacgctaacggacaatatcaaattattgttggaccaggcgatgttaatggtgtttacgatgaatttgttaaaattaccggtgttgagcaagcttcaactgccgatttgaaaaaaattgcagcacaatcaggaaaaagaaatcctttgatggatttggttaaagtattgtcagatatatttgttcctttgattccagctctggttgccggcggtctgttgatggcattgaataacattctaactggtgagggaatgtttggcgccaaatctttggttgaaatgtttccgcaaatcacaggtttagcagaaatgatcaatctgatggcttctgcaccgtttgcattcttgccgattttgataggaattacagcaacaagacgttttggaggaaacgaaattctcggagcagctgctggtatgatgttagttatgcctagtttagtcaacggatataatgttgccgaagcggttgccactgggaagatgccaacatgggacttgtttggtttgtcagttgcgcaagctggttatcaaggtcaagtgttaccggtgatcggtgtggcattcatcttagctaacttggaaaagtttttccataagcacttgaaaggtgctattgactttacgtttacaccgatgttgtctatcatattaactgggtttatcacatttattgttgtgggtccggtattacgaattgtctctaatggtattactgatagcttgacatggttggttacgacgtttggctttattggttacggggtctttggtacattctactctgctattgttattactggtttacatcagagttttccggcaatcgaaacacagttgttggcagatgttgctaaaacaggtggtgatttcattttccctattgccgctgcatctaacgtggcacaaggagctgcaacatttgctatttatttcttaagcaaaggggatgaaaaagtacgggcattggcttcatcatcaggtgcttcagccatgctgggtattactgaaccagcaatgtttggtgttaacttaaaatataagtttccatttttcatcgctctgggatcagcaggaatttcaagcttagtaatgggattgttccaagtgatgtcatcgtcgctgggaccagctggtataattggctttattgctattccagctaacaaatgggtaggattcttcatcgccattgcgttatcattcgtgattgcttttacagcaaccctagcttacggtcgttcacacatgccagtttctaagtcgggtaataaaccagcaaatccagtagttactgaacatgaagcaggttttgaggttgatgcacctgtttcaggtcatttaatacagttagccgatgtcccagataatgttttctcaactggaatgatgggcaagggtgtagcaatcgaaccgagtgatggtacgatttacgcgccggccgatggtgaaattacagtagcttatcaaacaaaacatgcctatggattgacgacggatgatggggttgagatattaattcatattggcttagatacggttaatcttgaaggtcagggatttgaaagctttgtaacgcaaggacaaaaagttaaaaaaggtgataaattaggtacctttgatacgaatactatcaaaaaagctggatatcctgttacaactatggtcattatcacgaacacaaaagcatttaatgatgttgcggtagatgaagctttcgataatgatatccaagcaggccatcagattataacggccataccaaaaactagtgattcagctgttggtgcgccagcataaatacaaaaaaggggaaaacgtatttatcaagaatacgcaactaaaataattcatgcttattaaagatgacatcaatcattttgaaaaatatcatttatatcccacacaaggattattgaatgatccaaatggacttatatattttaaaggacaatatcatgtgtttttccaatggaatccacatgcttgtaaccacaaatataaggaatggggacattttgtttcaaacgacttgaaaacatggactcgtttagaaacagctttaaagccttcacttccagacatggactcagctggaatatattctggtacagcatttgttaaagatgataagttatatgtcttctatacaggtaatgttcgcgatgaatctggccgaagtgtggcgtctcatcaaatgtgggccgttagtgaggatgggattcactttgaaaaacttggtgaactattccctcatccagaaggttttacaaaagatgttagagatcctaaagtttggcaggggagaaacgggcgatactatttgatggtaggtgcacgatcaaatgaaaatataggtgacattcttatttatgaatcggaaaactttagtcagtggcaattacatggttcgttaattgaaggtgaattaactgatattcgtggctatatgattgaatgtccagatttaattgagatagatggtaagcaaattttaatgttttcaccgcaaggattaccagcggatgaagagaactatcgctatcaaaacattcataacacaggttatgttgtcggtacttttgatgaagagacgttgcattttaaaccagaaacttcctttaaagaagttgacaagggatttgaattttatgcgccacaaaccatgcataccaatgagggccgtaaaataatgtggggatgggctggtatgatgacaccagaacgtgaagcttcgactccaacgattgctagcaacaattgggttcatgtgttaacgattccacgcgaattacacgtgacgtcggacaatcttttgacacagacacctatttcagaaattttgcatacaaaacctttgacgaactttggtgctgttaatgtaggtcaatatacaattgattctcacgacaattggacattatcttttggtgaaaatatgactttagttcgaaacaaaaatcaacttatattatcacgtcggcagtgggaaaatggtgaaattgaaaaaaggctggttgtaggagatattaatcacacattattaattgttgacacagacattattgaagtgtttacaaacaataatcaatcagtcatgacggcacgttatttttaagcattgaaaatatttgtgtaaacgattacaatgtaattgtagtaactggttaacgtctaacacaaacacgatgatttcgtgaaaaaggagcaattaaatcatgggtttattaggagcaattgaagcaggtggaacgaagtttgtggtcgctgttgcggatcacgattataatattgttgagagaacatcattccctacacttgatggtcaaaaaacagtagagcaagtcatcgctttttttgataagtttgacgacattgacgcaattggtattgcagcttttggaccaattgacattgtagagggatcaacaacatatggtcacgttctagatacaccaaaacgcgggtggtcaggatatgattttctgggtgcaatgaaagactggcgtgatattccttactattggactactgacgttaatggcgcaggatgggctgagtttgaaactggtgcagctaaagatgttaataacatggtttatttgacagttggtactggtgtaggtgcaggaattgtctctggtggcaagttagttgctggatatggacatcctgaagcagggcatattttcttacaaaagcatcctcttgataaatatgaaggtcattgcccattccatggcgataattgtttggaaggcttagctgctggtccagcaattgaagagcgttggggacgtagtgcgaaggaaattccagatgatgatgttgcctggaagattgaagccttctatcttgcgcaagcagcccttgattatacaatgattttacgccctgaaaaaattgtttttggtggcggtgtacctcatcgtgaaatcttattcccattaattcgcgaaagttttgctgagcaaatgagtgattatttagcagttcctgatttgggtgaatacatcgtacccgttgctaatggcgataatgccggcatcttgggttgcttctatttggcaaaaacattactttaattttcaatttatcctcagtttacgtgagtttaattttagaacgttatattataaacatcaacaaagcaagttatctcaaacaacaagcctagttgaattaaaatgtaacattcgataaatttatgatctggaggattggacagtataagcggtataactgatgagcatcacatcagaaacacgaagcctcacggcaaaagggagccaagtcgcgttctcccgcgcgactataaataactcatattctctcccgaatatactattctcttctctctcaaatattctctctcataataaatatccccggtgaacgcgttagttcatcggggcttcgtgtttctagtagaatttttatgataattagatattatgttgcacgatatttaaaaatatgataatatattttatgttgtgaaatacgaaaaatggtcagctagctcagttggtagagcaacggactcttaatccgtgggtccagggttcgagcccctggctgaccactatatgaaaccagcaaactttgtttgctggtttttattttaattttaaatatcgaggagaggaagaatgcaacggaatgtcgggaagaagcttaaaaagcatctgcttttaattgtgttggttattatgctgattgttgtggttgttatttgtttttttaatactaaacaaccaatcaagaacactggaaagatcgctaaaacgtcttctgtaaaaaaagtagatgatttaccaaaaggtgtaaaaacgacagattggaatttagtattagtcaataaaaatcattcctatcagacagaattgaactttacgaaggttactgtcgatagtaaacaaattgatcaacgaatctcacaagcccttgcaaattttcgttcagcagctcaaaaggctggttacgcgacaaccttagtatcgggatatcgttccattgcatatcaaaccactgtgtataacaattcaattagtcaatatgaatcaaatgggatgagcgcgacagaggccaaaagattgactgagtccgtaattcaggtgccagggtcctcggagcaccaaacgggacaagcagttgatttagcaggtaatgacgccttggctgcatatccctctttagaagcaggtatggataaattcaaatcacagcagtggttgataaaacatgcaccggaatatggatttatcctacgttatccgagtgatagtcagtctataaaggagacggggattgactatgaatcttggcactttagatacgttggtgtgtccaatgcaacatatattactaatcatcacctcacgctagaaaaatatattcaaactttgaaaaaggcgggtagatgatacaatatttgaccatcaaaacaattgctcagcaggaataatgtaattttgatatactatattagtaatatttttatttgaaactaaggagaaatggcatgattgtactatcaggcaccatcggcgctggcaaaacgagtttaacgaaaatgttggcaaaacatttagattcacaggcgttttatgaaagtgttgatgataacccaattttgccattattttaccaaaaccctaaaaaatatggttttttgctacaaatttattttttaaacaaaaggctagaacaaataaaaagagcccaagtggatgccaaaaatattttagatcgttctatttttgaagatgctttactattccaattgacagctgatttgaatcgcgcaacgcaaactgaggtggatatatatcagtcattggttaataatatgatggctgaaattcctggtagtgcaacgtctaaggatcctgatttattaattcatgttcgtgttagttttgatactatgctcgcaagaatcaaaaagcgtggtcgttcatttgagcaagttgaagcaaatccgggattatatgactactacaaagaacttaattcacgttatgatgattggtttgcggcgtacgaccgatcaccaaaaatccagattgatggtgaccattttgattttgtggaaaatgaagagtcaggtgcaaaagtcttggacatgattgatgctaaattagcacaaactggtgtactatcattttgagaaatcccgaaacttttgaagttagggatttttttgatataataattaaaattaactaaggaacatataatgaatagttggcatagaattgttgttaaagtcggcacgagcacaattgttaatcgtgatgggcaaattaattacccagtcgttaatcggttggcacaaacactttccagtttacaaaaatctggtcacgaaattttattagttacatccggggcaattggtgtggcattggatcagatgaatctagaaaaacgaccacaagaaattccacaacagcaagcattagctgccattggtcagggatacttgatgtcattgtacaatcaaagttttgcattctatcaacaattaattggacaagttttattgacgtatgatgtgttcgacaataaagcgatgcttgaaaacacaatgaatgccattgaaatgatgttttcacagcacatcattcccattgttaatgaaaatgatgtgattgcagttgatgagcttgaccatcaacattcatttggcgataatgaccgcttagctgctattgtgacacgtgaaattggtgccgatggattaattattttgagcgatgtcgacgcgttgtatacggctaatcctaatattgatgaatttgcacaagccattgataaggtaacgaaaattaccgatgatattcgtatgagcgccaccggatcaacttctggtttaggaacaggtgggatgagcacaaaacttgctgctggtgaatttgtgatgaaaaatggtggtaaaatggtgttaattaatggtaataatccagccttgattttagaagtaatagctggtaaaacggtgggaacattatttcaaggagaatgagtctatgaacgcagtggaagaaattggtaagcgtgccaaattagtgacttctgatgtcgctaatttggcagtagatcttcgtaatcaaatattattggatatgtcgtcagccttggtagctaactggcaagaaattgtggcagctaataaaaaagatttggacgcggctacgcagctctcggggccaatgcgtaatcgattgacgcttgaccaaaaaacaattggcggtattgcagcgtcgctgtcagcggtcgctaagttagctgatcctttggcaggtccatatgacaattggaaaaatcatacaggatttaaaattgttaaaaaaacagtgccactaggggttgtggcgatgatatttgaggcgcgcccgaatgtgaccgtagatgctgccgcattaacctttaaatcaggtaatgcagttattttacgcggtggtaaagaggctatcgagtcaaatattatcttaacgaatattttgcgtaatgtgttacgtaaacacaatttaaacccagatataatacagttaatcacggatacaacacatgattcagtcaacacattactaaatttgcgtgactatgttgatgtattaattccgcgtggttcaggtcagtttattgattttgttgtaaaaaatgcaacggtaccggttattgaaactggcgcaggtaacacacatatatttgtggacgagagtgccaagcaggatgaggctattcgtgtcattcataatgccaaaacacaaaaaccagcagtttgtaatgctgccgaaaaactattaattcatgaggcaattgcgggtgaatttttaccaaaaattgtcgatgatttattggctgctggtgtagagttgcgcggggaccaaaaagcccgtagtatagatagtcgagtaattggcgcaagtactgaagattgggatactgagtataacgatttaattatggctataaaaattgttcacaataacgatgaagcaattacctggattaatgaccacacaacccatcactcagaaacaattatcagtgaagatcttaatcatgttactgattttatgaatactgttgatgctgctgttgtttatcagaatgtttcaagccgatttactgatggttttgaatttggatttggcgcagaaattggtatctctacacaaaagcttcatgcgcgtggcccaatgggactaagtgcgttaaccacaattaagtatgaagtattcggtgaaggacaaattagagaataagcacagtatttttgacccaaaaaaatgatccacgatacggacaactaggtttggtgtcgtatcgtggatcatttttatgttattgaagcacagttagcattagattttgaaaatcatgaacaaatctttttgaatcaactaaaacagcagctttagtagttgttggaaccaaaagtttctctttatcaccgattgtgcggccataatcgccactctctttatcgtatgttacccgcattgctaaggcaattgatgtaacatagctaggatcgattccaacagcaactgctagtggatcgtggagggcagcaccatttttattgatgtttaagttagcatacgcatcaatatagaaatccattaagtcagcaaatttttctccggctaaggttcctagtgtacgccatgatgcagtttcttttttcgttagcagcgtgcggagagtaacatcaaggccaaccattgttaggttttgctgatgaatgaaagcaaagtcagctgcttcagggtcttggtgaatgtttgcttcggtaaaaggcgttacgttacctggtacagttaaagcaccgcccattagcgttgtattaccaatcaaggtagccacgtcattatctttttcaatcgctgcagccaaattggtgagtggcccagttggaataaaaattaggttttctttatattgatgagccgattcaattaaaaaatcaacagctgattgggtttcagtttgtcttggtgaagtttctaaggtaatttcacctacgccatttttaccgtgaataagctgtgaaataggcataacttcaaaattattggttgtacttgaatgactagcaccaataaatacagggacatcatcagcaccaagtaaatgtaataaattcagtgagttttgtgcggccgtttcaacaagtgtgttaccataactagagataataccaatcaaatcgacatttggatcagctacagcgtaggcgagcgccagagcatcatccacgccagtatccagatcaagaatcatttttttagtagccataaattgtaattatgtgcagacgcacatttcctccaaattgtaatatatattaattataacggacgaaaactatttttgttttaaattaacgcaatgttagaatgacgttgcaataaagtaaaatcggagaatatttaaatgacagagttatatgatgtagcaatcataggtggtggaccagttggtatgtttacagctttctatgccggattacgtgatactaaagcagttctagttgaaagtttagcaacactcggcggacaagtgacatcgttatatcctgagaaaaaaattcttgacgttgctggattcacaggaattaaaggatcagcattgattgattcattggatgaacaaatgaagttatttccaattgatatcaaaacctcaacaactgtgactaatgtgacgaaaacaaacgacttattcacagtgaccatcaacaatggttcgtcatttcaggctaaaacaatcatcatcacaacaggtaaaggctcttttgaaccacgcaagatgcaggtgtccggcgttgatcaattggttggccaaggtattcactattttgtaacggataaacatgattttgataaccatgatgtagcgattgctggtggtggtgattcagctattgatatggctacgatgcttaatgaatttacccattctacaagaattattcaccgccgggatcaatttcgtgcaatggagcaaagtgtgaaacaactgagccaatcatccgttatcaaagaaacgccgaaaaaagtatcacagattgaaaaacaaagtgatggtaaattgaaaattacgttagcgcaagtgaagaatgatcaggtaactaatgatatttgtgttgatgatttaattattaattatggttttatttcggaaaataaaattgtgcatggttgggatatacaaccagaaaatgaaggacaagcgttttccgtcgaccaagcaatgcagacgacgatacccggcgtttttgctattggggatgctagccattatgaggggaaagcagatttaattgctgttggatttggtgaagcgccaacagcagttaatgctgcaattcgattttttgatccacagcgacgtggccccggccattcgagttcaatggttattcaagatggaaaacttatataagtaaaaaagtagtagatgagtatatcatctactacttttttaaaagctacttagcggaatctaaaacagttgcttttcctgtagcataatcaatttgaatacctggctgtacgttgaaaatccaatagtttaagttcagtgttttgccgttgtcttcaactgatttagccatatagtgaacaccacgagcaagacgttcgttgccaacataaagtggcgtgacctgtgcacggaccgtaatagttggattgttttggatagcattgcgaatatcattttcagggacgagctgacctggataggcattttcaacacgtgtacccgtaatcatattttctgtgaccatagtgggtaacccgaaaaattgatagcccacaatgtgagatttattccaaagcgcttgcataccattgcctaatttaacgttagggttatcatgataaccaccgacccacttagtaccatcgtagcgatcgttaataaaccaaccggatgggcggacagtgtaaggaatacgatccggccgtttagtaacttttgatatggccgacttactggccacgaaatttccttgttgcgaacggcctaacgaatcaagagctgagaggcttaacccatcaactggattgagcttagatgcttgacttgggaaagtttctttcatttggtcgtctgtgaaggttgctttattgttgttgacatgaacgatgtcaccatctagcgttccatcccattttaagttgagcagggcctgatcagattgggcagttactgttggatgagatgtttcagtagaagtatttgtcgattcgtagttttgccacaaataaaatccggcaacaacaactagaatcagaagggatagtatcttattttgtggtttgcttttgcgtctataagtgcgttttcgtgccatgattctctctctttcaagttcttatatcataacatttatgctacgccaaaacatcaacaaaaacgataatagaaatcagcgttccagttcccactcggctttgaattgcgctaagaatgatagcatgaactgttgacgactttcagaaattttgcgtgctgtgtctgtatttaatttgtcctgaataagtaataatttttcataaaaatggttaattgtcgtacttttttgattgcgataatcagttttattttgtggtaaatgtggttgaatttctggatcatataatacacgattttttaccgcaccataagtaattgctcgtgtgatggcgatagctcccatagcctctaaacgatcagcatcttgtacaatttgtccattgatattgagctcttgagcaccttctagtgacttagaccaagacatattgtcgatgatataggtgatttcttctatcatttctggatgaacgccgatagatagaagaaacgaaatcatattattttttgctgcaagaatatcttcttgactatcgtataatttatcatcatagacgtcatgcagcaatgcggcagcacgtacaacaaaagcatctgcttttttctcatgggcaagaatcttgttagctagtgcaaggacgcgattaatgtgatcaatgctgtgtccagtattatctttagtgagtgcgtctttcatataacgattaatcatttcaagttgatccattttaatttcctttaagttttatttcgattgcttattaattagtttaaactaattaataagcaatcgcgtttaaaagttggattaattcgtaaaagtttcaatatatcataaataataacttgagtctctatgaaaaattattgattttagttataattattttaatataactttacctcatacggtaaaaatcatgcttaacgtagaaagagacgattctttttattgtgagtgttttaaagaaagaggaagactcatatgtcagaaccaaataatattttgtttaataccggaaatcacactgattcggctgtcatttatgacaagttttcaaaggcagaacagcaattttcagtaaaaaaggataagaccttttatattaccacgccaatttactatccgtctggtaagttgcagttgggaaacacttacacaacggtgctcgctgatgcagcagcacgataccaccgcttactgggtgaagatgtttattttttaacaggtacagatgaacatggattgaaaattcaacaaaaagctgaggctgcgggtatatctgaaatagattttcttgatggtatggcgaagcaaattaaagacttgtggaagctaatggatatttcatatgacgattttattcgtactacagaagatcgccatgaaaaagcagtcgctaaaatctttacgcaattactagaaaatggggatatttataaaggtgagtatgaaggttggtactctgtttctgatgaagagtactttacagaatctcaattagccgaagtctatcgtgatgacgcaggcaaagtaattggtgggaaagcaccatcagggcatgaagttgagttagttaaagaagaagcatacttcttcaagatgagtaaatacgctgattggttacttgattattacaaaacacatccagagtttattcagccagaagcccgaatgaatgagatgattaataatttcattgcaccaggtctggaagatttagcggtaacacgtacatcatttgactggggtatttcagtaccaggggatgagaagcatgtgatttacgtttggattgacgcattagctaactatattactgctctaggttataattcggacgatacaaccctatttgataagttctggcctgcaaacgttcaacttgttggaaaagaaatcgttcgtttccatactatttattggccaattatgttgcatgcattgggattagagttgcctaaatcagttgtaggtcatggttggcttgtgatgaaagacggtaagatgtctaaatcaaagggtaatgtaatctatcctgaagtgcttgaagaacgctatggtctagatgcagttcgctattatttattgcgttcaatgccatttggtaatgatggtgtatttacacctgaagattttgtggcgcgtgttaactatgatttagctaatgatttaggtaatttgttgaatcgtacagtagccatgattaataagtatgtggatggggttattcccgagctactaacaggtaagacttcttttgatgaagacttggttcgaactgtagaagatgccattgttgaatacaacaaaaactttaaagaattacgtactgctgacgcacttgaaagtgtttggaaaatcatccgtcgtgcaaataagtatattgatgagacacaaccatgggtgttggcaaaagatgaaaatgaaaaggaagttttgtctagcgtaatggctcatttagctggtgcattacgggttactgctgttttgttacagccagtattaacacaagcaccaaagaagatttttgatcaattaggattagattattctgacaaaggtgttgctattgcaggtttgactttcagtaagttaccaactggcggtcatgttgccaagaagggtgaaccaattttcccacgccaagacgttgaagaagaagtggcctttatttcaggactagtttcaaaagataccaaaggtaaagggcgtgcggttaaggaggcagcaaaagaggcagctcaggtggcgccatctaaggatttgattacttatgatgatttcgataaagttgaaatcttggctgctaaaattacggcaggagaaattgttgctaaatctgaaaaattgttaaagtttacgcttgatgatggatcagggaagccacgccaaattttgtcgggtattcgtaaatggtattcagaccctgctgctttggtgggtaaaacggttgctattgttgccaatatgaagccacgaaaaatggctggtgaactttctgaagggatgattttgtcggctgagaagaatgatattgttactgtaacgatattgccggattcaattgaaccgggttcaggaattgaataataaaagagcagctcttcggagttgtttttttatttgatttgacgaaaggacaattgttaactaaaattaactataaagtaaacattgtgataatagtggaggaaagtgatgagtacagctgataaactgttagctttgttggttaatacagcaggcgattgggtgtctggtgaagcaattgcgcaacagttagggattacccgaacttctatatggaagtctgttaaaaagcttgagtctcaaggacatctcatcgagagtgttcgtgggcaaggatatcgatatgtagagggcgctaaaatttctgctgttggcattaaaaagtatttaaaatcagatgtggatctgaaagtctttgacacgattgactcgactaatgtgtatgctagagagaagctttcttctggcgaaattactaaaaatacggttattgttagtgaaagcatgtcggcgggaattggtcgattaggaagaaagtttttttcgccgaaaaatacgggtatgtacgtcacttttgctttgccactacctgtggagacgatagtaaaccctggccgattaactactagtaccgcagtagctgtctcaaaaatggttaaagaagtatttgatatcgatattcagtttaagtgggtcaacgacttattgtacaacaacaagaaagttggtggtattttgaccgaagccattacggactttgaaagtcaacagttttcatctttagctgtgggtattggtatgaatcttgccacgcctgatggtggatttccagatgaaatttctcaaaaggcaggtgcgctgactgatgaaatggttgtatcaagaaatgaagttgtcggttctttaattaatcacttttttgatatgtaccaggattatcaggacgggcattatataccgcaatatcgcaaaaaggtggttggtgttggacaatcagtagaactaaagcgtggtcaggtgaacttaacggggataattagagaaatcgataatgatggttgcctcgtgcttgatacgaagcggggcatagagcgcattaattctggtgaaattactaaattactgttgccaaataatgaataccagggttagacactaaaaaagcaactacacagactgtagtcgcttttttagtggattcttttgataatttgtaactctactaaggttacaaaaaagattaaaccaacatcaattaaaaaatcaagtaaactggtaaaacctagtataccagtgacgttaattatgttacctatataaaatttaataataaaacacttgtatgcaaaaccaattaaatgaaccataattaagcagagatagttgctgaccaaggtattcaaaaattggtgatggctaaatagtttgttgccctttctaatgatagcagccaaaaatggcattagtgtaaaagcgattaagaaaccaaacgttgtcttgaatatatagcctagtccgccaccagatgcaaatatgggtaaaccgagtaatccggaaacaaggtaaagcactgtcaaccaagaaccatacttggcaccgagaatcggataaactaaaaagataaacgccgtttgtagcgaaatgtagtcgtaaaaaggaatcggaatagctactttggcagaaagcaccaatagagcaaagtaaatacctattttacagatagtttgtgcactaacgctaacgttcgtctgttgatacataatatataatcctctcaatattagatgttacccttttttattaaaatggataacaaaaacaatttactataaatgaatttctttgtcaaatatgttaccctttatatatgatttggttaacaaaaatctggaggaaagcatgcattataagaaacgtagtcaagaagtattatggttgccattcacgcaaatgaaaacgttgttcctggtattttggctgctgggaagatgttgacgggagggtacttaccattagccatcactatgatatctgaagcgatctatcaagttttttatgatgattacgatgaaataacattgtttcgcggtcattcttatacgggtaatcaattaggttgtgctgtggcattgaattggttagaaataaagagaagcgacaatcttttgaccctgatttaagagcagtttggcgagcaacattaaccatgcgaaattttggcttgctcacaagaccattgggggacacaattgcattcttgccgccattgattgcaacaaaagaagaaataaagcaaataattgtcataattaaagaaggcattcaaactgtcatggaagaaatgaatcatgaagaataagggctattttattacaggaactgatacggaaattggtaaaacctttgtaacggccaggttggcacgttatttcaataagcacaatcaagatattggtgtctttaagccattgatgagtggtacacgtagagaaaacccttgtagcgatgcctatattttaaaatccggtgcaaaggttttggatggtttagaagaaattaacccttttcaatgggatgaagcgctcgcaccagccttagctcaaaagcgtgcaaaaacagactattcattagatgatgtactgaaaaaatataatgtattagctcagaaacacaagggcatgttggttgaaggagcaggcggcattacagtaccatacggcgatgattttaccgtcacggatttagcgtgtgcgttgaatttaccgttgattattgtggcaccaaacaaactaggtgtgattaatcatattatattaaccattgaatttgctaaaaaccacgatttaacaatagcggggataatttttaatggtgtcaagcacaaaggtgtggtagaagatacgaatttaacactattaaaagagatgactgatgtaccaataattggtgaattaccatgaattaccaatcagataaacgcagaattacctttggaaaagtacatggatataaatctgttaatgtgatttattgatcatattggataatcagattaaataacaaataatactataaattttgagattaatgagagtactatctgcactcatgttaagaaaaaaacaaaatgttatattaagcagctacattcgctcaaaactgcactttgtgctataataatggtgttgactaaagtcaaaaatttttggaggatctaaaacacatgactgttaagattggtattaacggatttggacgtattggtcgtttggccttccgtcgtattcttgagttgtcagacaaggcttcagatattgaagttgttgccatcaacgatttgacaagcccagatatgttggcatacttgctcaagtatgactcaattcacggtactttgaacgctgaagtttcatctgacgacacaggtattgttgttaacggtaagcactatgctgtttactcagaacgtaacgctgctgacttgaagtgggttgctaacgatggtgttgattacgtattggaagctactggtttctatacatcagcagaaaagtcacaagctcacttggatgcaggtgctaagaaggtattggtttcagctccagccggtgcagttcctacagttgtctacggtgttaaccaagacatcttgactgcagatgacaagattgtttctgctggttcatgcacaacgcaatcattggctccaatcgctaacgtattggaacaagaattcggtgttaagactggcttgatgttgacagtccacgcttacacagcttcacaaagcttgcaagatggtcctaagtcagctaagtttgcaaagcgtcaagctaatcgtgacgcagcttcaaactcattgccacactcatctggtgccgcaaaggcaatcggaatggttgttccttcattggatggtaagttgactggttcagctatccgtgttcctgttcctgatggttcaattactgaattaactgcagtcttgaagaaggacgttacagttgaagaagttaatgcagctatgaagaagtacgaatcagattcatttggttacaatggtgacggattggtatctactgatatcatcaacgacacacatggtactgtcttcgatccaacacaaactgaagttgttgctggtgaaggacaacaattggttaaagttgctgcatggtatgacaacgaatacggtttcacttcaaacatgatccgtacattgttgcacttcgctactttgtaagatagattgttctgtttttcctgttagtgtactaaatcataatattagaaaacacacttcggtgtgtttttttattgtaaggtattctattatgtatattttttgaaaagaggcaagcaaatcttaaacaaatggctacttgtaggtacttatagtaaaaaatatgatatactttattcaaatatcgaacaggagttctatttgtgaaagttgcattttcatctgataatcattttgatttaaataaaattaatgttgaacgcgctatgcgggcacaagcgctctatttgttgaacaaaaatgtgaacgtttacgttattgctggcgatttgtttaatgactttaagcaatccttagcatttgcgcgtaatatgcaagacttagtaaaaaacaaattaaccattcgttttttggctgggaatcatgatatgggtaaaaatgttacatatgaagaacttgaaagtgatatcgacgagttatattttcataacaagtacattgacttaactgatgatatccgacttattggcaacaatggttggtatgattatagtttcgtcggtaatgattatacagaagaagaaattcaatcgtttaaaaatagctattggtatgaccgacgcattaagcaaccaataactgataaagaacgttttaatattaacctaaaacaaattaaggatcagctcttggctgcgggcaacaaacagactatagttgtgagccattttgtgccacgtgaagactatattaaacgttttccaaatgggaacacacgattggatatagcaaatgcgttccttggcagttcgaaaattggtcaagctgtcgatcaatcatataccattgcaacaattacagggcatttgcatttacatcccgcaccgttaaagttcggtaacaatgtttattataatgctgctgtgggttatagtactgaacgtgttcacgaatggtcaagtgatgattttctaacagaatggcaaaaaagactagttgtacttgaattttaaaacaccggataggtgttttttatttcttaaggaaacactatgattttagaatactttgacaatcgaaataaattatgataatattttgactatcagatatttcgattatcaaagtattttaaaaaaggaatcaattatgccagttcttacaacaacagaaattatggacttaattcccaatcgttatcctattctttatatggattacgtggaagaaatggtcccagatgaatcaatagtcgctgtcaaaaatgtgaccattaacgaacagtttttccaaggtcacttccctggaaatccagtgatgccaggtgttttaatcattgaatcactagcccaagcagcatcaattttgattttgtcatcaccgcaatttcaaggtaagacagcttacatgacaggaattgataacgctaaatttaagagaatggttaaaccaggcgatgtattgaagttacatgtcacatttggtaagctacgtgctaacatgggcagtgtgttagttgaagccaaagtcgatggtaaaacagctacatcagccgagttgatgttcgttgtggcgccagatgaaaaagatgaatgaagcaattacaactgattttgaacaaataaatactgaactggttggtgtatttaataatgtcatgtggatagaagaagctgctttaaaacgcagttacttctctgatataaccttaaaagacatgcacaccattgaagctatttcaatgtatgatgaaaaaagtgcttcacaggtcgcaaaaattattcatttgacaccaagttctatgacagcagccattgataaattggttgaaaagggttatgttgagcgacgtcgttccagtaaagacaggcgtgtggtacgattaggcttaacgcataaggggcgtgtcgtttatcgcgctcatcaagaattccacagggatttaacgcacaatctggtaaaaaatatgtcaccaaacgacgtgagcgttgtcaaacaagcgatccataatttggttagctatttagcacagataattaatcattaaagaggggaattatggaacaattgaaaatcgttgcttcagcacgtcaaattccagatcgacaagtgacgaatcaagagctcagcacaatgatggaaactgatgatgaatggatctatactcggacaggtattcatcagcgtaatgtcgtgacaacggaaaacactagtgatttagccagtgaagtggcaaagaaaatattggcgaaaagtggtgtttcaccagacagtattgactttatcattgttagcacgatgtcaccagacagcctatcaccaagcacggcagcaattgtccaggctaacattggtgccactaatgcattcgcattcgacttaagcgcagcttgttctggttttgtttatggattgagtgtcgcctcgagtctgttaatgtcacgctatcaacgtggattgattattggtgcagaagtgttatcgaaattagttgattggaaagatcgaactacggcagttttgtttggtgatggagccgcaggggtacttgtggaacgaacacaggataatgttggacttttaggtgaagaacttaggacttttggtgaaaagggtgacaatttagtagctggtaggtttgcgaatacaaacccattttcggaaaatattagcccgttagacccttattttcatcaaaatggtcgggaagtatacagctttgcaactcgtgaggttcccgaagcactccaagcagccttagagacagctcaagttacggctgacgatgttgattattatctattacatcaggcaaacgcacgtattgtatcttccattgctaaacggtttgggcagcccgtatctaagttcccaaccaacatggcttcaaatggtaacactagtgcagcaagtatcggtattttattagatgaattgatagagtctaatacaattcatgctggtcaaatgattgcctttgctggttttggtggtggtttaactgtcggcgcacaaatttggaaaatttaaatctatcggtgtagtcggctgcaccgcaaaaatctaacgaaaatacataaaacggattttaggagaaaaacactcatgacagacgcagaaatttttgacaagacaaaagaaattttggttgatcaatttgatttagaagaagatgaagtttcattaacaaccgatttaacaaatgatattgacgctgattcattggacttgtttgaagttttgaaccgtgttgaagatgattttgatattaagttggctgttgctgaagatatcaagactgttcaagatttggttgataagattaaagaacaattagcagcgtaatttaggtgacattttgtcacgtacataacataatttttaaggatgagaacatgacagttaaaacaatgaaccctatttttgaaaaattaggcatgaaatacccaattgttgaaggtgggatgacatgggctggaacaggtgcgttggcagctgctatttcagaggctggtggacttggctttatcggcacaggttattggcatggtgatgacgttcgtaaagaaatcagacgtgcaaaagctctgacagataagccttttggcgttaacgtaatgttattaagtcgtcatattagagaagtttttgatgtcattatcgaagaaaaagttgctgtagttgcaactggagcaggagacccatcgccatttttggatgagttacatgctgctggtattatagtaatgcctgtcgttccctcagtttcattagcacgtatgatggaaaaaaaaggggttgacgcggttattgctgaaggtatggaatcaggtgggcatattggtatgctgactacgatgacattagtacctcaagtagccgatgccgttaatattccagtaattgctgctggtggtattggtgatggacgtggtgttgccgctgcgtttatgcttggtgcggctggtgcacaaatgggtacaagatttctgacagctactgaatcagaagttcatcctaactttaagtcaaaaatacttaaagctaaagatattgacactattgttacgggtaatttgcttggtaatcgtgcccgtgttttgaaaaataaaatggcaaagtcatttgttaaaaatgaagtaaacgaattgcaaaaagaaaagccagacgctgcagccattgaaaaacttgaatctggtacactacgtcgtgctgttcaagaaggtgataaagaaggcggtgcattcatggccggtcaaatttctggtttgattaaggatgagaagcctgcagctgatatcttgtccgacatttgggcgcaagctaccgatttaatgggtattgaaaacacaacattgtaagtaaagaatccgattggtttcggtttcattgtttatatatagtatatggggtttaacatgaaaattggattattgttcagcgggcaaggcgcacagcaagccggcatgggcacagatttatatgaagcacttcctgaatataaatcaacaatcgatcgagcttctgaagttttaggatatgatttatctgacgtgatgaagaatgctgataaaattgcacaaacgcaatatgcacaacctgctatcttatctatgagtaatgccattgtgaatgctttgggtagtgctttgcaacagccagttgcagctctaggattgagtttaggcgagtattcggcgttgactgcagctggggccatgaactttgaacaagctgttgctattatcaaagatcgtgggcgatatatgcaaacggttggagacgcaaatcctggtaagatggcggcaataatgggcgaagatcaaaagctcattgaagctgttttagctcaattgcaggccaaaggaaagcaagttttcccagcaaactataatacgtttgctcaactggtcattggcggaattgctgctgatgttgacgaggcaaaagcgacattaacagcggctggcatcaaacgtacgattgatttgccagtctctggtgcatttcacaccccattattgaaagacgctgctgttcagttatctgaacggttggcaactgaagcatttacagatgtggattatcctgtttattccaatacaacaagtgaaccgtttattatcgcggatctccatgaaacgttgactaaacaaattgtatcgcccacatatttcgcgcaagcgatgaaaaaaatgttagatgcaggtgttgatacatttattgaggttggtccttcggatacattgattaagtttgctaaaaaaattgctcccaaggatgtgaaacgatacgctattaaagatttagaaagctttaatgaagtaaaagaattgctcacagcagaagaggtataacatggcagattttacagataaaactgttttagtaacaggctcatcacgtggtataggacttgcaattgcaaaggcatttgatgctgcaggagcaaacgtcattttacatgcacgttcagaaattagtcctgaaactttaacagagtttaagtcagaaccaaaaacattacagtttgatattgctgatgcagaagcagcagaagccagtttgaaagtattatacaagcaagaaaacttttcaggtattgacatattaatcaacaatgccggtattacaaaggatcagctagctattgcaatgacaccagcagattttgcacaggttgttaacgtaaacttaaacggtacttttaatgtgacacaacctgtatttaaaaagatgattcgacaaaagcatggggcgattattaatctagcctctgttgttggattaatgggtaacatgggtcaagcgaattattctgcatccaaagctggtctggtcggcttgacaaagactctagctaaagaaggtgcacgtcgccacatccgagtaaatgcgattgcccctggtatgattgtttcagatatgaccggtgctttgccagaaaagacacaggaagagattctaaaaaatattccattatctcgttttggtgaagcttcggaaattgcagatgtagcattattcttggcaggtaatgattatattaccggtcaaacaatcacagttgatggtgggttatacatttaacgcacaatttattgatgtgaggcactgagaacataaagaaaggaaatgcgtcctcggacatttgatttaaattcattagtataatgtctttttaatcagtgtccgtccacgctcttaatattatgacacgcgtagtaattacaggacttggcgcagtaacgccattaggaaacgatacacagtctttcttggacggtattttcaatgaaaaaattggtattaaaccaattacaaaatttgatgcatcagagacgggaatcaccgtggcaggacaggttgatggttttgatcccgcagctcgtgttggtaagcgtgatgcacgcaagatggatttgttttcacagtatgcggttgatgctgcagatcaggctttgactaatgctggattcaaggcagaagaaggtgctgaagcaccaaccactgttgctgatcctactcgattcggtgtaattttaggtaatggtattggtggcttgactactatacaagatcaagtaatcaagatgcatgataaaggaccacaacgtgttagcccattgtttgtgcctgaatcaattcccaacatggtatcaggaaatgtttcgttacgttttggtgcaaagggtattaattcaacaattgttacggcttgtgcttcagcaacaaatgcgattggggaagcgttctggcgtattcaatctggtaaagccgatgtcatgttaactggtggttcagaagcaacggttaacgaaattggtattgctggtttcgcagccttgactgcgttatcaaaggaagaagatccaacacaagcttcaaagccttttgataagaatcgtcatggatttgttttgggtgaaggttcaggaattttggttattgaaagtctagaacatgctcaagcacgtggtgctcatattcttgcggaattagttggttatggtgcatcatctgatgcatatcacatgacgtcaccatccccagatggtgaaggtgctgcacgcgcaattcgcgatgcattaaatgacgctaatttggaagccaatcaaatttcatatatcaatgctcacggaacagcaacaggagcaaatgattcgggtgaagcacatgctattgccactgtgtttggagaaaatacagtacctgtttcttcaacaaagggaatgacaggtcatttgcttggtgctgctggtgccatagaagctttgatttctgtaggttctttgacacgtggtgaattaccagtaaacgtcggtcttgatgaacaggacgaggacactaaggtagttaatttagttgatcaagaaaacaagcatcaagcacctgagtatgtaatgagtgctaattatggttttggtggtcacaacgctgtcatcgtatttaagaaatggcatgaaggagtgtaattgatgagtttaaatattgcggaaattcgtggattaattgctgatttagagaacagttctttacgcgaattcaaagttgttgatggcgaattcagtttgcatttatcaaagaacaaaaatgaagcagtcgtgaacgcgccagttcaaactccagttgttgctcctgccgatgttacatcagagcaagctcaagtagctgcagaacctgaaacgcttaaaacaggaactgaaattgttgctcctatggttggaacagtatatttgcaaccaaaacctgatgcaccaatgttcaaacaagttggtgataaggtctcagtgggagaaacagttgctgtgattgaagcgatgaaattaatgacagaaattcatagtgaagtcagtggaacagtagccgaaatactagttgctaacgaagaagtagtagactacaataagccactctatagaataacaacagattaaatgtaattttaaggtttgtatcggtatgaaatataaatatcatacaaacgtacataatacatactacgaaggagccaaaatgtcgattctaaacacacaacaaattcaagaaatattacctcaccgttatccaatgcttatgctagatacagtggaagaattagtaccaggtgagagagcagtagcaattaaaaatatcagtgtcaatgaagaaattttccaaggccatttccctgggaatccaactttcccgggtgctttgactgtcgaggcattagctcaaactggtgcggttgcactgttatctatgcctgaatttaagggtaaaactgcttacttcgggggcattaaaaaggctcgttatcgtagaatggttcgtccaggagatcaactacgtttagaagttactttggatcgtttgcgcggaccaattggtactggcaaaggtattgtttgggttggtgacaaaaaagcgacaacagcagaattgacgtttattattggagactaaaatgttcaaaaaggttctagtggcaaatcgcggtgaaatcgcggtgcgtattattcggacattgagagaaatgggtattgcatcagttgctgtttattcaacagctgacaaagatagcttgcacgttcaaattgctgatgaagcaatcgcagttggtggtgttaagccaacagattcatatttgaatatgaaaaacattctgagtgcggcactattaacaggttctgaagctattcacccaggatacggctttctgtcagaaaatgctctatttgctgaaatggttggcgaagtaggaattaaatggattggcccacgtccagacacaattgaattaatgggtaacaaagctaatgctcgtgaagaaatgcgtcaagcaggtgttccggttattcctggatctgacggtttcatccgtgacttttccgaagctaaagttgttgctgatcgtatcggatatcctttgttgctaaaagctgctgctggtggtggtggaaaaggcatgcgttttgtttatagcgaagatgaattgagcgacaaatttgatgatgcccaaaatgaagcgcgcctgtctgttggtgatgatcaaatgtacattgaaaaagtgatggaacatgtccgacacattgaaatgcagcttttgagagatgaaaatggtcatgttatctatctgccagaacgtgattgctcattacagcgtaaaaatcaaaaggtgttggaagagtcacctgctgtaggtgtaacgcctgagatgcgtgcttatttaggtggtattgtaacaaaagctgcgcaagcgatcaggtatgagaacactggaacaattgaatttttgcaagaccatgagggcaatttttacttcatggaaatgaatactcgtatccaggttgaacacccagtcactgagatggtaaccaatttagatttaattagattacaaatagaagtcgctgcagggcaagatttacctataacacaggacgatattcaagttaatggtcattccatcgaagtacgcttgacggccgaaagacctgaaagtaattttgcaccaagtgcaggcacagttgatcttgtatttttacctaccggaggacctggtgttcgaattgattccgcactatttgtgggcgataaagtccaaccattttacgattcaatgattggtaaattagtggcgaaggcagatactcgtgaacaagcggttcaaaaaattcatcgcattgttgatgaaactgttgtgcatggcatttctacaagtttgaatttccaaaaagctttattggaagatccacacgtgcagcgtggcgaatttgatacacgctatttagaaactgaattcttaccacggtggactgagagcttatcagaagatgaataatacaatgccgcatgcgtttgacgtgtgcggtattctagtaaatggagacatttaatatggacttatacaacaataaaaatagcgatacatcaaaaattaaaagagatgcttcggttaatgatcgcattcctgatggtctttttctagcgtgcccatactgtggtgcacaaatgtacaataaacagcttggcaaatatcgtgtgtgtgcaaagtgtaattatggttttcgtctccaagcatgggaacgtgttgaattattgactaaaaactttgaagaaatggattcagatatccaaatggatcatccagagtttccaggttatgcagaaaaactaaagcgggcacagtcacaaactgagttggcagaatctgttttgactggaacggctgacattgaaggggaacaggtggctttaggaatcatggattcctacttcatgatggggtctttgggttcaatgacaggtgaaaaaattacgcgcttgtttgaatacgcaacggctcatacgttaccggttgttttgttcactgcatcaggtggcgcacgtatgcaagaaggaattgattccttaatgcagatggccaaggtttcagcagctgttgcagcccaccaggaagctaagttattgtacctagttgtgctaactgatcctacaactggcggagtaactgcaagttttgctatgcaaggggatgttactttagctgaaccacacgcgcttgttggttttgctggggcaagagtgattgaatcaacaatacatgaaaaactaccaaaagactttcaacgggtagagacattattggaaaatggttttgtagatcaaattgtacctcgatcagaattagctcaactgattgccaaaattgttagattacatacagcggaggccgaataaatgcctgatattttaagtggattgaaattatttaaacgtgaattaacgccagcgcaagtggttaaaaaatcccgtgaagaccgttttatggcgcgggaaatcattgatggcatttttacagactttgtcgaattgcatggtgatcgtctcggtggtgacgatatgtctatcattggtggcattgcatttttagcagaccggcctgttacggtgattgttgttgacaagggtacagatattcatgacaagttgagcaaacgtaatggttcgccagagccatggggctaccgtaaagctcaacgtctaatgcaacaagctaatcgatttaatcgtccaattatcatgtttgttaatacaccaggagcttttccaggcaaagaggctgaggcgcaagggcagggtgaggcaattgccaaatcaatcctagactcaatgaagttaaccgttccaatgatttctatcatatatggtgagggaggctctggtggtgcacttgcattggctacggctgatcaagtttggatgttccaaaatgcaacctattcgatactatcaccagaaggatttgcatccattctttggaaagatagcaaacgtagtgaagaagcagcggctgttatgggactaactgctaaagatctcttggagaaaaatgttattgagtatattattccagagtctcgtaatcatcctcgagttttcaacttaattcggaagcggttaaatgacgagatacatacattgaatcaattaacaccagatgaactattaacgaagcgacgtaaccgctttagagcattctaatccgataaatatgttataataaagtctcccagataatgggtagattttagacgggtctgtttttggaattcgacaggtcgtttagagcattgattgcgtttcgccatccgggcgcaaaacgggcagaaattttaactgcaaaaaacgaaaactctttcgctatcgctgcctaaaaaccagtgatgcgtagcttaatcttggttgctggcgtctgaggttaggccataaaaggccagatcgtactgcttcttacatctggaaaagcagtattaaatcaatcaggttagttatattgaagagccttgagctatggcagacaatataatgaactacaaataatagccctataaacgtagatattggtgtatcgggcgatttggacaggggttcgactcccctcagatccatttagcatttcatggcgttgcataaggtttcaaaaaccttgatgtagcgccttttcttatgaaaaacgttgattgtgaggaaaagtaaaatggagtcactcaacttaattgaaggcgttgttgcacgtgtgtaccaatgtgacgtaacacgagtatcagaagaatcacaaaataacgaatatgaagggacaactttatttgttggtaacaaaagtcttcgtacccgtttggcgaagaaaacacctactaaacaaggatactttgtcgtgttgtgggaaaaagacgacagaggtcaaaataaaccatttgatgcgtacaatagtcctgagttattagtggtttgtgtgatagataatcagcaaaagggagtcttcatttttcctaaagtgttactggtacaacagaaaatattgagttcgcagcaaaccaaaggaaaaatggctttcagagtttatccagattgggtagttgaattaaataaaactgctcagcgaacacaaacctggcagaaaaattactttgtggatttgtcaactgatcaagttgatgaagatagatttaaaagattgctttctaaatctaactgttgattaagatactatgaaataaataccagttatgcagcgtcttgaatatctgcttgacgaactgtctaatttacggtaacattaaaataatcttagaggattaagcaagcgcacgtctagagagttgatgtttagtggaaatcaatcgtgttaatgcccaaggttgctgagaattataattaatcatattaaataaataagcggtcgtttaaaaacgacaaattaggtggtaccacggtagaaagatcgtcctaatctctgtaatttgagattaggacgatcttttttcgtgttacgacttaaaagaaaggaattaactatgcgtgatattgatatgtcaacaaagtatgatccaacttctgttgaagctggtcgttatgacaactggcaaagtaaaaagttatttgcacccgaatcaaacaaagaaattcaaggcaatgagccagaaccttattctattgtcattccacctcctaacgttaccggaaaacttcatttagggcatgcatgggatacgacattacaagacatgatcattcgtcaaaagcggatgcaaggatttgataccttgtggctgcccggaatggatcacgctggtattgcaacgcaggcaaaagttgaacaaagattacgtggtgaaggtgtttcacgttacgatttgggtcgtgaaaaatttgttgaacaagtatgggactggaaaaacgagtatgctactaccatcaagcaacaatggggtaagatggggctgtcacttgactttgaccgcgagcgctttacgcttgatgaaggtttgaataaggctgttaacaaggtatttattgatctatacaataaaggattaatttaccgtggggaatatatcattaactgggacccacaggcaagaactgccttatctgacattgaagttatttatcaagatgatgctggcgcattttatcacgttaagtatccatttacagatgggacaacattcgacggaaaagattacattgaaattgcaacaactcgtccagaaacaatgtttggggatgttgctgttgcggttcatcctagcgatgaacgatacaaagatttaattggtaaaaaggttttggtgccattagttggtcgtgaaattccaattattgcagatgagtatgtagaaaaagattttggtactggtatggtgaaaataacaccagcccatgatcctaatgatttccaagtgggtaatcgtcacgatttggaacgcattaatacgatgactgaagacggtcatttaaatgaatttgctggtaaatacaatggcatggatcgtttcgatgctcgtaaagcaattgctgctgaccttgaagctggcgattacatgctaaaagtagacccaattgttcattctgttggtcattcagagcgtacaggtgttcaggttgaatcacgtctatcaacgcaatggtttgttaaaatggaaccattggctaaacaaattttagacatgcaaaagaatgacgatgaaaaggttgaatttgtaccagcacgttttgaagatacattttcacgctggatggaaaatattcgtgactgggttatttcacgtcaattgtggtggggtcatcaaattcctgcttggtacaaaaataaaggaacagataaagaggaattatatgttggtactgaagcaccagcaggtgacggctgggagcgtgatccggatgttttggacacatggttttcatctgctctatggccattttcaaccatgggttggccagaaaagctagacggtgacttcgcccgttattatccaacaaatacattagtaactggctatgatattattttcttctgggtagcacggatgatgttccaggggaaagaatttactggacaacgaccttttaaaaatgtcttgattcatggtttaattcgtgatggtgaagggcgtaaaatgtcaaaatcattgggtaatggcgttgacccgatggatgttattgaaaaatatggtgctgatgcattacgctggttcctagtaacggggtcaactccgggacaagatttacgatttacttacgaaaagatggattcggcttggaacttcattaacaaaatttggaatgcgtcacgttatgttattatgaatttggatgaagatacaccatctacgttaccagatatgagtcaattaacattagctgatcaatggattttgtcacgtttgaatacagtggttacgaatgtaacacgtaattttgacaaattcgagtttggtgaagcaggacgtgagttgtacaacttcatttggtctgattttgccgattggtatatcgaaatgaccaaggaaactttgaatggtgatcaagataaggcaccagttcagcaaacattggcctacgtattggatcagacattacgtctattacaaccaatcatgccatttgttactgaagctatttggcaggaaatgccagctcaaaatggcagcgaagccgattttgctattgtaaaatatccggtcgtgcgcgaagagttaagcaatcctgacgcagaacaagccttcaaatcgttgcaggatttgattgtagctgttcgtaatatccgagcagaagcaaatgcaccaatgtctacaccaattgatttaatgattcaaaccacggatgataatttgaagcacatttttgaagcgaatgctgattatattaatcgttttgctcaccctaaaacgttaacaatcagtgatgatgtgcaagctcctaatttggcaatgtcacaagtaatttcaggtgctgaaatttatgttccactggctgagctgattgacattgacgaagaaataacacgcttacaaactgaagtgaaaaaatttgctggggaagtaaaacgagctgaaggaaaactaggaaatgataagttcgtttctggggcccctgaagcggttgttgctgcggaaaaagaaaaattagctgattggcaagccaaacttaacgcaacagaagaaagattacagacattaaaggcaaatcaatagaaattataaaatcactcttaacagggtgattttatttattatttgacaaggtaatgagcaatagttttgtatggtaaaaaaatcaagtagtggacttttttcttaaattcgatacaatagttagagtataaaatagcgtgtaatatatggcagtatgcaattttttaaggagagttacaatgtccggaagtaaaatactcgcaagtgcacattatgtacctagagacatcgtgactaataatgatttagcaaaaatcatagataccagtgacgagtggattcaggctcatactggtatcaaaacgcgacatatatcattgcaaggtgaaaatacgagtgatttagcgacacgtgccgcggagtcagtattgagccaaactgatattaaaccagaagatattgatttaattattgtaacaacatttaccccagatggattggcaccgtcaacggcagcattagtacagcgcaatttacatgctgaaaatgcttgggcctacgatattgtaacagcttgctcagggtttgtttttggattgagcacagctgacaagtttattaaatctggtcaatataagaatgcattagtcatttctgcggaagtcaactccaaaatgatggatttcaaggatcgcaccagtactgtcttttttggagacggtgcaggagcagtgctgatgacagctgatgatgccggtgttgtggaagctgaaaaaatgcacacaatcgggaatgccgatgttgtacattcagggcgaatagcaccactgacaagtctatctgtggataactatccaaaaatagatgctttttcacaacaaggacgtaatgtatttgatgaagtaacaactattgttccagatcatatccgcaattttttgagcgaacataatttatcaactagtgatattgattactttataccccatcaagcaaatttacgtttgatcgagtatattgcaaatgatctcggcgaaccaatgacaaagttttcaacaaacgttgttacgaatggtaatacatcatctgctgggatcgctattggactagatgaattaaataagtcagttagcttaaatggaaaacgggtattgctaactggattcggtgctggctttacttatggcagcatgcttttacaattttaaagaaaaccttaagagttttagttggatttaataatattgaaatggtgaaaaatgcaaaatgaagcgtactttttcaccatttttatgtggaatgagttcatttttaaattattaaaaggtcttaaaatgcctatgtatcaacgtttattcgagtatgacatatttcagtaatattgttacaatattgatatagtcgcacaatacacacgttacaacaaacggatatactaattaatgttattaagatttgcttaacagtaaatctaaaatttaattattacgagttaatacaattcattcaggagttacataagaatatgggtaaattttttaagaagactttattgactactgcagctggtgctgcggcctttgttggtgggcatgcagcagcttctgctgatacagtagaagtgcaatcaggcgacactttgtcaaaaattgcagcagcaaacaatactactgttgatgcgttagctaaggctaatggaattagcaacaaagatttgattttagcaggttcatcactagaaattaacgcaacacaagaagtttctggtttatcagaagatggcacatcatatacagtgcaatcaggtgatacattatcaaagattgctgaaaaaactggtgtggatgtatcagtattgtcttcattgaatagtttgtcaaatgctgaccttgttttgactggacaagaattgtcattgaaggcttcaactactcaagcaaccagttcagctgctactactgtgactgcagcttctgcacaatcttcatcggttgacacaagtaatttgaaatatattgcagcagctgatacagacagcaataactttatgacgcttgatgaatataatacatatgttgcaaatggtgggtcaacatcatcagcggcgacagaatcatcagcaagcgcatcatcagctgcagaagatatcacatatattgcagcagcagattcagataatgatggttacatgacaatggccgagtataatgcatacaaagctaatggtgggtcaacatcatcatcagcgcaggtcactacatcagcggcttcgtcttcagcaagcacatcaagtgcttcgtcagcaactaatgataacatcacttatgttgctgcggctgacactaataacgatggctacatgacaatggctgagtacaatgcgtacaaggctaatggcggttcaacgactagcacatcatcagcttcttcgtcaacgacaactactaatactactaccactgccacaacaactaacgtttcaactggtagcacaacggcagatgcaacaatcaacgcatggaatgcaaaacgtgcagaattaggattatcacctgttacaatttcttcatcattgactgcacaagctcaaagtcgcgcgcaatcaattggaacatcttcaaactggtttagcacacatatgtcttccggtactgccgaagttgttgcagatggtttcggtgctggatcttctgttattaatgcttggtattatgaaacaggtatggtcaacggtgggcataaggaatttattgttaaccctaacttcacacaagcaggtgtgggctattataacggttggattgttattaacgcacaataatatgcaaaatgattatttgaaattagcattagataacttaggaaaaacattcaacgactacaatagtggtcgttttgttgctcaacagcttatgaaagcgcaagtaccattacccgaaggatcacattgggattcttcaccagcgcacctcattaaacaaatgcatcatttactgggtgttttacaagcaacaccaggagatttgttattttggggcacacagaatgcaccatatgaagtgggtatttatgtcggtgggaaccactttatcgctgtaaataacggagatcatgtggcaaaaattcaaacgttatcaaggaattggtatccatgtattgccggttctatattttgacacacaattgtcatttagatgttttttttgttacaaaagaaactcctttgatatattgacaacaaagtgcaaagtacagaaaatatccatgacacagcggattgctatactaggaattgtcgagaagacggaaaagaatttaaattaaaatatattactgaatatgagtccctattaggagtttgactattatgaaaaaatctactattgctaaatctgtcgttacagctgccggtgcttttgccgttgctggtgctgctcaagtttctgctaatactgtatcagttaaagctggtgacacactttacaagattgcatcagcaaacggtacaactgttgacgctttggttaaagctaacaacatttcaaatgctaatttgatttttgttggacagcaactacaaactgcatcttcatcatcaactactacacaaagttcatcatcagagagctcaactacaacaacttcatcatctaatggttcatacactgttaagtcaggtgatacattaaacaagattgcagcagcaaatggtacaacggtagcaaatttggtagcagctaataacatttcaaatgctaacttgattactgttggtcaaacattgaagttatcagcttcatcaacttcaagctcaacaacaacgcaatcatcaactacgacaactcaaacaacatcaaataacacagcaactgcctcaaatggttcatacactgttaagtcaggtgatacattaaacaagattgcggcagcaaacggtacaacagtagctaacttagtagctgctaataacatttcaaatgctaatgtgattactgttggtcaaactttaaagttgtcagcatcatctgcttcaacttcaagttcatcaactgcaacaacatcacaatcatcaagttctacacaatcatcatcaacttctaataatactgcttcaacatcaaatacgagcaatacaagcaacagctcatcaacttcaacaacagctgatgctactattaatgcttggaatgcaaagcgtgctactcttggtttgtcaccaattaagatttcagcttcattgacagcacaagctcaaagccgtgcacaagctcttgcaacatcatctaactggtttggtttacatgaatcatcatcaactcctgaagttgttgctaatggttttgctgcaggtgcaactgtgatcaacgcttggtttaacgaaactggtatggttaacggtggtcacagagaatttattattaattctagcttgactgaagctggtgttggttattatgatggatggatcgtcattgacgcacattaataacaccaaaaagtggatagttgctatccactttttttgtgttctcatgtatagtagagtgcagaggtataaaaaatgttgtacaaatttactgaattaacaaaagaagaatatacagaatttgaaaagcaaagttctgtgggtacctttttacaatcaggtgaacaagctgaattattacaaaaacgaggctataaaatatggttgttaggtatcaaagctgacgacaaggtagtggctgcagcgttggtcatgcgtgaaaaggtacatatgggatacatcttttcaattgatcgtgggccattattggattttgaaaatcatgaattgttggcttttttcatgtctaatttcgtaaagttttcacgcgagaataaagggctttatattgaagtaaggccaaatgtgactttgaaaatgacgaataaccatggcgatcttctaggtgaagagaatacggtgtttatcgaagagatgaaaaagcttggatttactcatttgccatttgtagatggtttcactacagctggttctccagaatgggagtatatcaaagatttgtcagaattaaccgatgagaaatctgttcgtgcctcgtataataagaaggctcagtattatttaaaaaagaatgctcagttcggtattcgtttacgtcaattaacacgagatgacttgccagattttaaggaattaacacaaaaaactgccgataggttacattataaagataaaaacttgaatttttatcaaacagtatatgatgtgtatggcgatgatgcaacatttgtctttgctgaactaaactttgacaactatattaaggaagagaatgaaaaaatctctgaattagatgccaaactggccaaaattaatcagaagatcgaaaaatatcctacgaatgataaatttaagcgtcagtatgctgaatttgatgatcaaaaaaatcaacatagcaagcgcatattaaaagcggaacaacagaaagaagctgctggtaaatcgacagtcgtcgtcgctggtgcattatttatacagcaacctcaagaaatgaattatctgtattcaggcacttatgaagagtatatggactattacggcccttatcaaatacaagacgttatgatcaacaaggcagttcaggcaggactcaagcgctataacttctacggtattgctggaaagttcgatggtagcgatggtgtactaggattcaaaacgacttttgagggacaagcacgtcaactggtaggaaacttcatgatgcctgttaatccctttaaatatggcgtctatcgattactcaaaaaaatgatgggccgtgcttaaaatgagcttttttagcgagtaaaacccgttttgtggtatggtatataaggtaattattaaattggcggtacacaatacttatgaaacacaatccatatctagaagagcgagataataaaaatgacgcacgtgccaacttaccaacacgtctgcgaattttgttgtttatatcgtttatactaatggttgccctagttgtacaattagggtttttaacgattaagcagggagccaattatttggctgaagtcaaccgaagtgaagagaccgttgaaaaaggaaatacaccacgaggtttagtttacgactcaaccggccgtgttctggctggaaacaaggcgcaaacggcgattacatttacgcgtggtactaatattacttctagtacaatgcgaagcactgcaattaaacttggaaaatatttgacagttgatacgacccgcctcagtgatcgttctaaagctgacttttatttggctgacgcaactaacgcggctaaggtgcagaaacgcgttgctaaagaacataagaatggtagtagcctgacgacatcagagattaatagtctgtcggtaagttatgtagaagagcataacttgctttcaaaagttagtgataatgatgcaatgatatttcagcggatgagcggtgcttattcattgtcaacgacatttatcaaagaagacgatgtgacagaaacagaattagcggagattggcgagcgtttaagccaattccctggtattaagataggtacaagctgggcaagacaatatcctgaaggaaacgattttaaggctttgattggtacagtaactagtgaagataatgggttgccagatgataagttacacacactcttagcccaaggatattcacaaaatgaatcagttggtagttctaatttggaatctagctatgaatccttattgaagggatcagcctcacagactgtagttacaactgcttctgacggtacggtaaaatcatcttctgtaaaatacaaagggcagtctggagatagtcttaaattaaccattaatgctgactttcagaaagaagttcagaaaattttggaagacaatttaccaactggggatgttcaaggtgcttatgctacagtaatgaatccctatactggcggtatctatgctatggcaggcgtagacagagattactcaaccggaacaaaaacagctgatccgttgggaaatattaatcatgctattgtcatgggatctgtggttaagccggcggtattagctacagctttccaaaaaggtgtgattactccctcaaattctacattgttggatcaagctattaaaattgcgggaacaccaacaatcacatcatattggaataaaacaggtacgcctgtttcagttgatgcacaaacagccttagagcgttcttcgaacacttatttcgttcaattgggtatgaagattggtggacagacttatagctcgggatcggcattagcattgaattctgatgcctttcagacattacgtaatgggttaggacaattcggattagggacaaaaacaggtattgatgtcagcggagaaactgctggttatcgcggagatactacagggtcaaatattggtaaatatttgtacgaatcatttggtcaatatgacacctatacaacacttcaacttgcacgatacgtttctacaattgctaatggtgggtatttgattcagcctcatttggtaagctcaatattacaaagttcaactaatagttcaaaaaagcgtacagtgtggacagccacaccgaatatacaagggcaagttcagttggattctgacgaatggaaagtaatccatgaaggaatgaatcgtgttgcaaatggtacggacacgtacaatactggtggaacagatatacataaacttgaaccacatgtttatgctaaaacaggaaccgccgaaacaacaaccaatggacatacgacttatacagaatccattgttgcttatgtaccgggacaaccgatggtcatggccatggctatcccaggtatgaataattatttagatggtaccaatggtaagattgcggcaaaaataattaatgcttactggaagtatgttcaaaataaaccataactttataaaaaagacagtaatcatgattactgtcttttttattcttacctattttgctatatttctaaatagatgttataatctatttagaaatatagcgaaataggtaaaggaaagaaataatgagtttacaaaatacactgaaagcgatttcgaatcctgtcaggcgtgatattcttacgctactgaaagaagggcctcagtcagcgggaagcattgcggatcattttgaattgagtaaagcaacaatatcatcacatttagcccaattaaaacaagctgatttgataagagaagataaatataaaaattttatttattatgaattaaatttatctgtgtttgaagaagccacattatggttgaaaggatttactaatgaaaaataaaaaaagctttttaccactaattattaccttgttacccattttttatgggctaatattgtggacgaagctgccagttgagcttccaatccattttaatattaacggagaagtggatagatatgctaataaagtatggcttatcattatttggccaataatagcaacactcttgcacctgcttctaattatttatcgtacgaaaatagttgctcgtagtcaaaataataaaatgcatacaattattagttggtctattccattaggcaataacattttattatcttatatatttgcttatggattaggtaatcacatcaatataactagtatattgttgccgactattggcattttatttatagcattaggtaactacatgcccaaaacacagcgaaatcgctttgttgggatacgaataccaaccgctctgaataatgatataaattggtttaagacgcaacgtattggtggtttgatgtttgttgttggcgggtttatgatgattggtggtggttttttaggaatgatttctgaattttggactatagcattaatgattctgtccttagtattaattactgtcgtaccgattatttattcgattagatcaaaccataaagcttaacttgagtcggcatagtagtgtttttcacatttgatcaaacagaagaaataaataagaaactaaaatatttaacggaaaagattgaaaaagaacatgactattgtatactagattacaactagtcaaaagtagtgtactaatttaactatttttaaaagggttgcatattaaacgacatagtaaattcaaaagagggagaaaaagtatgtcatttttagaattaaaagatattcataaatcctattttttaggaaaagatgaatttccagttttgaaggggatcaacttatcatttgataaaggtgaatttgtttccattcttggtgaatcaggtggcggtaaatcaacactaatgaatattattggtggccttgatcgaaacttttcaggtgatgtgttgatcaacggaaatcgattagatcataaacaagaaaagaagttagatgtttatcgtcgtgagacgattggctatattttccaaagctttaacctaattaattatcaaacgaacttggaaaacgttgaaaccagcttaaacatgactactttatcatccgcgcaacgtaaacaacgtgccatggaattattggaaaaagttggtttgagcgagcatgttcataagtatccatcacaactttccggtggtcaaaagcagcgtgtcgccattgcgcgtgcgttagcagcagatcctgatgtcatgattgctgatgaaccaacgggcgcattagattctgtgaataccactgaagtactggagcttcttgagcaaatcgcccaagaaggtaaattggttattgttgttacgcattcacaagcggtagctaattacggaacgcgtattttgcacatggctgatggaaaaattgatgaagaaaaaaatttgaaagacaagtttgaggcaccatcggcacctgatcggttaacatcgagaccgttgtcaactagatcagtttgggacatggcctttgatcatttgaagtataaaaaattacaaaactttttgattattctcggatcggctattggtgttttctcggtaatactattcctcggattgggtaatggtattaaagggtatattaataatcaagttagttcgttggctaaccctaactatccaactgttgttaagaacacgttagatgatgatgatgcgtcaagcaatgaacgtgttcaagccagagcgcaagcatcaacaacaaattactcgtcgattgttttttctgataatgtaattaaaaaagttagtaatgtaaaaaatgttgccaagacttatcaaggatatgagtttaatggtgctgtattcaagtacgggaaagcacaatcacaggctggtacgcaggtacaaacatggtcaccaatctatgccgacaaagtcatcaaggcggggcacaagccatctggtgacaatgaaattgtgattgacaaaacatttgctcaaaaagctaataaaaattggaaatctttgattggtaagaatatcacgtatacttacgtagcttataatcaaaataatcaagcagttcctgtgacatcaacaatgaaaattgttggaatcactgacggcggacaagctggtacagtgtttgcaactacatttgctgcaatgaaaaaagacttagcaaaggctaatgccatgaccgaagctaactatttgacattaaaggttaatgatacggaaaacgtaaagtcaacagtgagtgcggttaacaaaatcaaggataatggtaagcaagccgtcgtggcagtatccattggtagtgtgctagacacgattaacacaattacaagtttggcttcatatgtattggctgccattgccggaatttcattgatcgtatcagcgattatgattattgtgacaacttatatgtctgtttctgaacgtaccaaagaaatcggtgtattgcgcgcacttggtgcacgttcaaaagatattcgtggtttatttacaaatgaagcgctgttaatgggaatcatttcagctgttcttggtattgtcacagcttatctaggacaatttgctatgaacgcagctttgtatggcttaattaaatttgatattgtacaggtttctcttggtaatgttatatttgcggtagtgatttctcttgttatcgctctagttgcttcatttgttccttcgcgtcgagcggctaatttgaatacgattgatgcattagcagctgattaatatgttgaacaaaaaacattcacttcttgtgagtgtttttttgttattgattagacatgttataaacaaaaatgtcaacaaaagctctaaaataaatcggctaacctaattaatatggcgttattattaacttaattgtattagcgccattcttggttttaatggtataatattaaatcaggatatcgctgggggtacaaaacaatggataataacatgagtcgaatggcacgtcaaaatcaagcgccaagaccagacgataagcaaccacgaaaacctaaaagacgacataaaaaatggcgttggattgttagtataattgttattctgttgattattgttggcgttgtgatatcgatgctattgagtaatatcaaagaatcggttgatacaatgcatcgtagtgcgaatattacaaaagctcgcgatgttaaccaagtcttaaaagatggcaaaccattttcaattttagtactaggtacagacacaggtgctttagcacgtgatcgaacagggttaaccgattctatgatgctaatcactgttaatccaaaatctaaaacaacgacaatgttgtcaatccctcgtgatattatggtttcaattgtcggtcgagaagatacttttccacaaaaacttaatgctgcatttccaattgctggtgttggggcaacgatgtctacgttgcaaaactatttgaacgtaccaattgacttttacgctctggttaacatgggcggacttgaaaaagttattgatcaagtaggtggcgtgaaagttaagtctccactaacattcacttatcagcctgaaaatgacaagtctgatgtttataaattttacacaaatcaagaaaaatatgaatatgcctctgatggtaagaattttaaaacgtatacgacaatggatggctacgccgcgttgtcattttcaagaatgcgttatgacgatccagagggagactacggtcgacaaaagcgtcaacggctagttttgaaagctttggttaaaaaatcagccagcgctaaaactctactgaatgcaaagtttatgaaatcaatatctaaaaatgcagaaacagacttaacttataataatgtgacaaaaattgctttatcttacatggcagccactaaaaatcagaaatctgatcatttacagggcgttggtgatatgtataatggtgtgagttaccaaatggtgaaagcatcagaaaagcaacgtgttacaaatctactacgcaaatcattaaacttgggcagtaaaacaacaggaacacagtttggtagttcggtacccgtactatcttatggcgttgctgaatataacttaaatgttattggtgaaacattagacgcgcaataaaaaaatacttccctcatatttgtttgagggaagtatttttttatttgaattactcacgtgtttttgctttggtaaagggaatgccgtcgcgccaaagatagccacgatagtagctttccattgatataatctgtgttaacgaggtgagtggtagtacccattttagccaaacaatatctgtcttgaaaaatgggatagccatcatggcagcagtcactaaataaattaaagcccgcccctttagtgatagttgccgatcaaaaacagcttcgtcaacgtacttttgataatatttattgttgtgtagccaactatctagctttttagaagatttagaccacaaaattgcggttagaacataaaatcctgttgttggcaagccgggaatccatatcgcgatggtaccaatagcaaaactgagcgccccaagggcaattaatagtattttcatatatatagtgtaccatcacatggtacaattaaactaataaaattgattaggatgtctatatgagctatttagcaatcgttgatcttggtagtaattctgccagaatggtagtcgaagagctgcatgatgatggtactcatactgagttaatccgcgaaaaaagagacacgcgtattgctcaaaatatgggagaagaactactattaaaagaaacaccaattttgcgtactattgaggcgctaaaatattttcaatctaaatatatcaattttcatccgaaagtccgtgcgattacaacggcagcagttcgtatggctaaaaatcaaactgagtttttagatcgtgtcgcacgagaaacgggaattcagtttcaagttttgacgggtgatcaagaagcatattatgattatttgggtgtgatctcaaccttaaatgttaccgagggtgtgattctagatactggtggtgcttcagttgaattgattgctgtggataatcgacgcagcaaggaagctgtaagcttatcttttggtgcagttactttatcagaacaatatcacttagctaataatatcatgccgaacaatctggcttccgcaagtgattatatattaagtcagtataacacgttgcagtggttggaaacgcaataccaaaagccagttattttattaggtggggcaaatcgttcgctcgcgcgtatggcacgtacacgacttggtgaaaccgaagtaagtatgattcatggatttgagatgccagttgacttagttgagcagatttttgaagaaatccgacagatgacacgaaaagaacgtgagaaaattgccggattagaaacttctcgcgctgatattatcgtcagtggcttactaccattattgaatcttatgagaaaaattaattcacctaaagttatattttcagaaagcggggttcgcgaaggtctaattgctgagactttagcacagcaggatgagtaaaaaattttatgaattaacacccgatgagcgtttactcgcattaaatttaaaagaagatatacgattatcattttcaagtcgtcaaagcccagttaacgctcaaatggttgagaattacattagtgattttcgcatgccaatgggcgttgttcatgatattctgattgatgaacaacattttagtgtgccgatggctattgaagagccaagtgtgattgcagcagctaataatggtgccaaaatgttatctaatggggttcatgtcatcattgcggatactgctatgatcggccaaatgttgctggttgatgctgctggtgtggatgaattcattaacttacatcgcgatgagatttttgctaaggcaaagcaagccaaaccatcgatttataaacgcggtggtggtttgcgtgatgttcgagtaagaaacatctcgaaaacggaaacgagtgttgactttattatcgacacaaaagacgcaatgggcgctaatattgttaatacaattttagaagcagaattaccgttgtttgaaaagttcatacctttaggtgtgattttatctaattatgccacaaatcaattggtcacagtgactggtgatgtcgattttgagcgcataggtggtcgtgaagtagctcagaaaatagtcgcattaaaccatttttccaaaaacgatccttaccgtgcaactacggagaataaaggtctttttaacggcattagtgctgtggttttggcgacgggtaatgattggcgagctgtagaagctagtggtcatgcctatgcaagtcgtgatggtcaataccgtggtttagtaacttggacaattttaaacggtaaacttcatggtgagctgacattgcctatatctgttggcacggttggcggtgcaatttcggctatgccagatgctaagcaggccttgtcaatcataggtgatgtgaatgctgacacacttcgtggtgtgattttatctgttgggttggcgcaaaatttagcagccttaaaatcaattgcctcaggcggtattcaacggggacacatgcgaatgcagtatcgcgcgttagcgatgcaagtaggcgcaaaaactgatgaaattgccgcagtagtatcacggctaatatccctcagtcatgtggatgcaagtgttgccaaaaaaatattaatggagataagaaatgaacccaaaaattaaagatttattggataacgttaatggtgtctatccaggaactgtgatgacacgtgttaatggaggagagactggggaattacatatcgaccaagtttcacaagaaattttaggacaacgtttgctaatagaaattgctaacaaaactgagagtgatttcttgcttggtaatgagttattaaaaatgctattaacattaaatggcattgccccacaagtattttttgcgctaacattcaatgatggaaaattagacgatcagctgatacaaattgcaacgcgcatgcatcgtacagttgttcatgcaatcacctatcgtgaattagctaagcaaggcattacaacttctgcgacggtaaaggcttatttttctgggcttaacgctgagttaacgcctgaaaatggtgaagtggatgatgaaagtttatggcgtttactcatgatcttggatgcattagtatttgctaatacgatttctgacagcagttttgttgccgagttgcaacaaaaatatccgctagcttacacggccgcgagttcgcttattaaacctgtaatggcagctgatctgaagcaggcacgtaatattcgtcatcaaatggtttctttgtttgaaggcattgacgaagtattgacaagatggggcaaacctactgtaaacgctaaagaatatgtcacattaacaagtgtcttgtcaaaacgtcaattagatttaccagttaatcaagtatttacaatatatcattcggaaatgaccgattttcagacgcagaagacagcttacgttgggctaagtaaaaatgataatcaaaatagttttgtagtatcgccaccggataatgaagctgataaaccaacctttttcaaagaactgtatgctctaaaagtgtcggaactattccaaaagttagcgctaccttacattgaaagagactaaattaattattatcagttaacattcataaagaaaggatattcatgttagtcacagcagaaattcaaaagcgctttgacaacgccaaaaatattgtattcatgaccggagcgggtgtttcaactttatcaggaataccggattatcgttctaaaggtggtatttatgatggcattagtttgcaacctgaatacctattgagtgcaacagcttttcataatgagcccgaaaaacagtatcaatttatgattgataatatgtactttcccgaggctgttccaaatgttattcacaaaaaaatggcagctttaactcgacaaggtaaggccaaaattatcacgcaaaatgttgatgatttgcatgtcaaagcggcatcggatccagaaaaattgatccgttttcatggctcattatatgatgtgtatgcgcctgttgatggccataaatctccctatcaggattacttgcatgcaatgagacgtgcagacaatgccttattacgtccgcgaattacattttacgaagaaatgccttttgacgttaaaaaatcagccttatgggtacgaaatgctgatttaattgttattgtaggcactagctttaaagtttatccttttgctggattattgcaatatgctagtccggcagttccggtgatgtcaatcaattttgaacgtattgctacgccatttgatgtggatcagattgttggggatgcaggcgaattcttttcagagttaaaagtttaaataaatatgaatacctaaaaagtagcagattaatctgctacttttttaaatatatgaattatttttcagataaagtgttaaaatagaatcgaggtgaaaatatgaagaaaccaatggagcagttaaaaatgaaacaaatgccttatttaataggtatttctttaaatatgatttttgttttatctgagttagtatttgctaaattagcacattcaaccgcactatttgctgatgctttccacaacttaagtgatgtattagcattaatgatcgcttggcttgcagttgtagtatttggtctacaagccactaaacggcatacttatggatggcataatatgtccattctagctagtgtatttaatacaattttgttaatatttgcggtgataacgattttttacgagagtattcgtaatttgattttgccagaaaatactgttactacaggctggttagtgatggttgttgcagcggttggtatcgtgattaactttgccactgctatgctttttaaagcatcaggtgttcctgatgaacatgggcatcaccatgaacaagatttgaatgccaaaacagcttacattcatcttttagctgatgctggtgtgtcggttggcgtgattattgctggacttttaatccaagttactggctggcacgtcattgatcctatcgtatcaatgattatcggtgttattattgccgtgacttcatggccagttatgaaatcaacatttaacttagcattaaatggggtacctgataatgtgaatgagtcagacgttttgcgatacttatcaacacatgaaggtgtggaacaacttcacgatttacacatttggcctctttctacgactgaagctgccatgactgttcatctatctgttaaaaagaatgtagatgaacaagaattattagcaaatatctctagtgacctacgagaaaaatatgatattagccatgtcaccattcaaattgaaacaaacgaatttgatcagtcttgtaatgtcatttgatataaagataaaattatgtcacgtaactaatttgtaatattttaataaaatagcgttttacccctttaatacaatgtttttctatcataaaattgataatacacaactttattttttgtaagtaaaaaatttttgttgacgaatttagaattgggtgtattataaagtatgtattagagcgattatagccgagttaggtaattttcataagctttcaacagccaagttgaatgaaattctttatgaaatttatttagcacttgatgttttattttggtgtttatcaattgtcaaaaagtgaatatttcacgatatttcagtcaagtcgaaattcgtttatttagctctgaggagaaatctaaaggagagatagaatgcaagattctacaagtgttaatccgaaacatcaccttgttcaaaaaactgaggatgatttaagtttatcggatgttaatggttccatagaagtaccagaaaatgggtcattttggcgtaaattattggccttttctggtcccggagccttggtggccgttggctatatggatccgggtaactgggttacttcggtagccggtggtgcgcaataccgttatacattgttgtctgttgttttaatttctagtttgattgccatgatgctacagtacatggccggtaagttaggaattgttaagcaagaagacttagcgcaagcaacacgtgatcgtacaaataaagttggtggattcgtactatggatcatgactgaattagcattgattgctacagatattgccgaagttattggaggggctatagcacttcacttattgttcggttggtcaatgattgcatctgttctgaccacagcttttgatgttattttgttgctattgttgatgaaatttggcttccgtaaaatcgaagctattgtcatgacattgatcattactattttggttatttttgcttatctagttattttatcaacaccacaattatcagcactgtttggcggttatttgcctcaattgcagactttaagctcacatacgccaattggtggtggtgattctcagttaacattaacattgggaattatcggtgccactgttatgccacataatctgtacttgcattcatcaatatctcagacacgtaaagtagatagaagtaacaagtcagaacttaaagaagctgttcgcttcatgacttgggattcaaatattcagttgtcattggcattcgttattaactcattattgttgattttgggtgcagcattattctttggacatgctgataaagttggtacatttggttcaatgtataacgctttgaaggataactcaattgctggtgctattgcatcaccaattctatcaacattgtttgctgttgctttgcttgcttcaggacaaaactcaacaatcactggaacgcttactggtgaaattgtcatggaaggtttcttgcacttgcgcattccaatgtggctacgtcgtgttgttactcgtggtttggcattgatacctgttgttgccttcacattgatttatggtggatctgaaggtaagttagatgatttgatggttcaatcacaagtcttcctttcaattgctttgccatttactatggcaccattaatctatttcacgtcttcaaagaagattatgggagaagaatttgctaatccaaagtggattgcagtcttaggatggattgcatttgctgttctgacatatttaaatgttcaacttgtcgtacaacaattaatgggatcttaatcaatatagatactaagcgatactaaaggagagataaaatgagtgaattaaacttaaacatcgaaccaacacaatttaagaacatcttagttggtgttgatgaatcagaacaaggttactttgctttggcaaatgcgattcatcaggctagcgaagatggtgccacattgacaatagcaacaattcttgaaatgggggacctatcagcaatcgaagcgctacaccttgactttatcaaggaaaagcgtgctgaatttgaagctaaccttgttcgttacaaggaatatgcgttgtcaaaaggggctacgaacgttgaaacagttttcgaagatggttctaaagctggagaagtattagtccagaaaattgcgccacaagtaggtgctgatttaattattgtgggtgcgcattctcgtgaaggcttctggggatcattaggatctcaagcagcttacattgctcgccatgcaaaagtatcttcaatggttgcacgtaaagagaattaaacatcattaatgaaaagtcgctagatagcggctttttttgttttatttaatacattacgatatagaggctgttataattaaaatatgaaaaaagaagctatcatagaacttgaaaaaatatttaaactattaggcaataaacaacgtctaattattttagaattgcttagagagcgttcttacagtgtttcagagattattaattctttaggtatggagcaatctgctgtatcacaccaattgaaactattgcgtgaggcgcaacttgttgaaacagaaaaacgtggccgcgaagtattgtatgggttaagtgattcacatatcttaattttattagataatgcgcttaaacacgtgagccacaccatcacagggaatgttagtgatataacacgtcaagtcaaaaaagaaaagccaaaaaaaggttgacgaacaaatattttactggtattctaatatagttgtttaatatttaacgccgctgtggcggaattggcagacgcgctggactcaaaatccagtggtggcaacaccgtgtgggttcgactcccaccggcggcatcaacgaaagtagtaaacataaagcattacacaattattgtgtggtgctttttttgattgttatttttaaaaatgatgttttgtatcgtaaatgtaatacattttgtgtgcaaatgtttttcattgtgctagaataaaaaaatagagtaaatttatgatgagaatttagcgaggaaaatataatgaaaaattggcaaaaactcacacttgtgggagtagcccttgtagcggtagttggtggcactcgtgctgctggattgtggggaaatagtgggaacagcaatgataagacacttcgcttttcattaccaacaccactaaacgggttagattcagcgacaattactgatgaatattcgataacagttgttggtaacgctggtgaaggcttaatgcgagccgataaaaatggcaagccacaaccagcattagctaagtcagttaagtcatctagtgacggtaagacctggacaatcaagctgcgtaatgggcttaagtggtccgatggtagcaagttaactgctaaagatgttgtgtatgcttggcaacgtgccaatgatcaaaaaacggcttcggagtatgcctatttgtatagcggtattaaaaatgctgatgctattcaggcaggtaaagttgataagaaggacctcggaattaaagcgagtgggaatacattaactgtttcactagaaaagccaatgccacaatttaagagcttgctaacatttccaacatttttcccacaaaagcaaagttttgttgagaaatatggcaaaaaatatggcacaaccgcaagcaagacattatataatggtccgtatacttttaaaggatggaatggaaccaataacaagtttaaacttgtgaaaaacaagtattattgggatgcaaaaaatgttaaaacacctgaaattgatttgcaagttgttcaaaagccagaagtggctgtacaaatgtataagacgggtaagttagattcagcactggttaatacgccacaattgtcacaggccaataaaacaaataagggctaccgaataacaccacaagccacaacggtattcttagcatacaatcaatcaggaaatgttaaagctctaaataacaaaaaaattagacaagcactgaatatggttacgaatcgttctgagttgaattcccaagttctatcgggcacttcaacaccagcaacatcatttacacctaaaggcttaagtactgtgaatggtacggattttgccacatatgctaagcaagattatacgtataataaatcagaggcacagaaactattcaaagaaggactaagtgaactaggtgaagagtcgattacgcttgaaattgaagctgatacagaccgagtagcaaatgccaaagatgtagtcaactatcttcaaggacaatggagtaaaaacttgccaggtctaaaggttaccgaaaaatttgtaccatttaagcagcgtttgcaagatggaactgacgctaatttccaagttatgctgacacaatggggagctgattatgccgaaccaacaacattcctggatctggcttcaactggcaatgcaaacaattataatcataattctaatgccgattacgatgctttatggaataaggctaagggagctgatgcgacgaatgatacaaagcgagctgctgatgaaaagggacttgagaagattattcatcaagaagcaattttgaacccactatattatcaggcacagccagaattggttaaccccaacattactggtttctatcatcatgcggtcggtgtaccactggactttaagttagctgctcgtaaataatgattagataaaaaagcacgctagaaagcgtgtttttttattaggcaatatggtaaaaaagaaaataaaaaaccacgaagcagaatctaaatcaaacttgcttcgtggttgctgcaatcgaatcgaccgcttttcctattaagcggccaaaacgattgagcgttttccgttagaattactcaaaagttatgaccccctttcctagattgcttatataataaatctactaagcagaaaagtcaaaccttttgttctggtataattaattgaataatatatagaggtaaaataatgacgattccacttatttttgatactgatcccggcattgatgatgcagcagcaatcgcaattttgttaactaatgatgactttgaagtacgtttgattacgtctgttgccggtaatgtttcggttgataagacaacaaacaatgttttgaaattaacacactattttaatcgaccagacgttaaggtggcccgtggtgctgagaaaccactagtcaaaccatttaaggatgcatcaaatattcatgggaagagcggaatgccaggttatgaatttggcgagctttctaccagaactataagtaaaaaagctgtagatgctattcatgaaacgctgaatagctatgatgatcaaacgacattagtagccgttggtgcattcactaatatcgcaaacttaattcaaaagtatccacaagatttacaaaaaatagagcgattaatcgtaatgggtggttcgcttaccggtgggaatttaacatcggtggcagagtttaacgtatttacagatccggacgcagcgaaaattgtttttgaaagtgatttggatatcacaatgattgggcttgatgttactgaaaaagcgttgttaaccaaaaaatctatgtctgaattacttcagatgaatgagaccggaaaaatgctgatgggactgtttggacactatcaagatggttctaatgctggtggtaaaccaatgcacgatgtcaatacactttattacttactgcaccctgaaaaatacaaattagaagatttatgggttgatgtcgtgacagatggacctgcgattggtgccacggtagctgacattcttcatagtacgcatagccaaacgaatgttcatgttgctaaggatatcgatgtacctgcattcaatgcttggtatttactacaaatttctggtatttctgatggaaatattaatgctggaaggcttgaaaattaagcgttttttaggtattctggtattagctgaaactggcgctttttcgtgctgaattaactgaaatcggagcagaatattgacaaacgaagacttcatcgaagcattaagtagtgctggtataactttaacaacacagcaggttcggcaatttgaacgttattacgagttgctggtcgcaactaatgaacacgttaacttaacggctattactgaaaaaaaagacgtgtacttaaaacatttttatgattctttaactgtagcaatgtatgaacaaaagttaaaaagctctgaaagcactttaattgatattggcacaggcgcaggttttccgtcattacccttgaaaatagcctttccagacttaaaaattacaatggttgatgcgttaaaaaaacgagttaattttttgcaagaagtggttgatacgctcgacttaaccggcgtagaaatcgttcacgggcgtgcagaagatataggacaaaatccaaagtaccgggaaaatttcgattatgcaacggctcgagcagttgcccgtactagtgttttggctgagtatacattaccttttgttaagattggtggcagattcttagtcatgaagggatcagctgcccatcaagagctcctcgatggtcaaaaagcattagctatgcttggcggtcaggttaacgaagagtttgtatttacactaccaaatggtgatcagcgttatatacagatagtagataaaaaaacaaaaacacctaaaaaataccctaggcaagctggaacaccaagcaaaaagccaatctcataaataaaggaggcacctaaaatggcgcaaataattgtattagctaatcaaaaaggtggtgtgggtaaaacaacaaccagtatcaacttgggcgcagcattggcacaagctggacaacgtgtgttactggttgatattgatgcacaagggaatgctacaagtgggtcaggtgttgataaatctttgttagagcacgatagttatgatgtaatcgttgaacaaacgccacttcacgaagtaatcgtagcgactgataattatgacctagtcccagctaccattcaattgtccggtgctgagattgaactcgctaagcaaccgcaacgtgagtatcgtctaaaaacggcacttgaaacagtgcgtgatgattatgacttcattttaattgataatccaccagctttaggactaatgacggtcaatgcatttacagctgctgatgccattcttatcccggtacagaccgaattttatgctttagaaggtctaggacaactactaaatacgattgaacttgttcggcagcagtttaacccagatcttgatgttgctggtattttgttaacaatgtatgatggacgaacgaacctcgccaagcaagtggcccaagaagtgcgtagttattttgatgataaggtttatgatacaatcatcccacgttcggtacgcctgagtgaagcgccatcttatggacaagcgattattgattttgatccacggagcgtgggtgcacaaatgtacaacaatctcgcacaggaggttttgaaacaatatggtaagtaaaaaaggcgggcttggcaaaggcatgaattcactttttggcgcaaataatgtgtcaaaagaagccgttgaacatacaaaggtggttacaaaagaacaagaagcaacggaacaagtcgttaagttaccattgaaagatatccaacctaatccgtttcaaccgcggcatcattttgatgaaagcaagctaaaggaattatcagcatctattacagaaaatggtgttttgacaccaattattgtacgtcaaattggtcaaaaatttgaaatcattgctggtgaacgtcgtgttcgtgcttcaaaattatctggtttgaaatcaatttcagctattgtacgccatgtcgatgatgacacgatggcagcactggcgttgatcgaaaatttacaacgtgatgatttggacgctatcgaagaagcacaagcttttgacgcacttatgacacgcttgcaaatgacacaggcagaagtagctgaaaaagttggtaaagatcgcgctaccgttgctaacttactgcgcctattgaaattgccggaatcagtacaagtactgattcaagatggtgagttatcaatgggacaggcgcgagcattactaggattaaaaaagaagccgcaaatcgaaaaagtagcagaaacagttgttttccgtggattgaatgttcgtcaagtggaaaacttggtcaggcaaatgaatgatggtgtacccgaacccaatacgaaagaaatttcaccctttgctgtttctttgtctaaccaattagaagaaaagtttgggaccaaggtcaaagtcaacgcgggccgtaagggaaatggtaaaattgaaattaattatgtttccaatgaggacttaagtcgcattttggcattgttagatattgaggtggactaatggcaatagcaccggactataaacttcatgatatcgttgagatgaaaaagccgcacgcttgtggcgccaattcttgggaaattacacgtgttggtgctgatattaagctgtcatgtacgaattgcggtagaggcattatgatgtcgcgttttgattttaacaaacgaataaaaaagattttacaagtagcaaatcagaaagaagaataaaatggcactaactgctggaatcgtcggcttaccaaacgtcggcaaatcaacactatttaatgcaattactaaagctggtgctgaaatggcaaactatccgtttgctacgattgaaccaaatgttggcatggtagaagtcccagatactcgcttggcgcgtatccaagaagttgtacctgctgataaaattattccaaccacgtttgaatttaccgatattgctggtattgtcaaaggcgcttctcagggagaaggtttagggaataaatttttagaaaacattcgtcaggtaaatgctattgtgcatgttgtacgagcttttgatggggatgaaattattcacgtgaatggggtagttgacccgttagatgacattgaaacaatcaatactgaattaattttggctgacttagaagctgttgacaagcgttattctaaagttgcacgtgcggcaaaagggaatgataaaaatgccaaagctgagtttgttgtactagaaaaaatcaaaccagttcttgaagcgggcaagtctgctcgcaccattacatttactgaagaagagcaaaaaatagttaaaggtttgttcttattgacaacaaaacctattttatacgttgccaatttggctgaagatgatatggcagatccaatgggatcaaagtatttcaatcaaattaaagagtttgctgccactgaaggagctgacgtaattggcttgtctgctagcgcagaagaagaaattgctcaattgccagaagaagaaaaagctgaattcttagaaatggctggagtagaggaagctggtttaaataagttaattcgagcagcctatcacttattagacttacgaacgtttttcactgcaggtggtaaagaaactcgagcatggacattcactgcgggatcaaaggcaccccaagctgctggtgtgatacactctgactttgaaagaggatttatccgtgcagaaacaattgcattctcggatcttgatgagttagggtctgttaaagcagtcaaagaagccggaaaattacgttcagaaggtaaggaatacgttgtacaggacggcgatattattgaattccgtttcaacgtgtaaatggcgctgatcgcgctgtacataatattttagggagacattttatgtcagaacaaaaaagagaattgacgaaaaaaaatcaggattttatctttcaatttaaaaagctgttagctcaaaacagtaaattgactggtgaacaaattgaaggtattgtgactgaggttgaaaataatcttcttgaaacccaagggaaagggcagacagcagcgcaaatttatggtacgccaacaatggctgttcagcagtatcttgatcctaagcgaacggccaagaaactttttgattataaatttagtactttggcactcgatacatctttagccatcttcatgttatttgctgtggtatttggtttgacattgttcttttccaaaaatgctagtaaccaaggtgcgggaatcgtttccttgcttcttatcgcagcattgggtggctcaatctatacaggtgtagtcttaaagttaacaccaaatcctaaagcaaaagacaaacaagaaccaacgagtcgtcgatgggtttacctgttaatggctgttgtggcttggcttggaggatttttgatattaggtatgttaccacaggtaattaatccaaccttaccaccagttgtatatattattcttggtgccgcagcatttggtgtcttccgttggaaccgtaagaaatacggtttaacaggtgggttcttcgcaatcagtcaattatcacagcaagcacgtttagaagcatctaaaaaatagttactattgttgcagacatttaagaggataatataaatgaaaattttagtagttgatgatgacatcgaaattgcagaattacttgaaatttacctaaaaaatgaaggctatgagccaattatggctgacgatggtaaagaagcactttctaagttgaatacaaatccagacattgctttaatgattttggatgttatgatgccaaacatgaacggtttagatgttgtaaaaactgttcgtaaggatagtcgcattcctattttaatgttgtcagcaaaatctggtgatatggacaaaattcagggactaattacaggtgcggatgactacgttaccaagccatttaatccgcttgaggtcatggctcgtgttcgttcattattgcgacgcgcggagaatgctgttcaagatcagacaccagatgtcttggacattggctcgctaataattaataaagacagtcacgaagtcaagacttctacaggtgatttggtcaacttaacggctttagagtttggtattttgtatttattagcatcgcatcctaatcgtgttttctcggcagatgatattttcgagcgtgtctggcaacaagaatctgttgtttctgcaaaaaccgttatggtgcacgtttcacatttgcgagataaaattgaagaagccacaaatggcgatcaagttattcaaacagtttggggcgttggttacaaaattgaagtgaatcaatgacaaaagtagcattgatattaaagcacaatcgtactaaaatatattatttggtagtgacgatattgttactacttctttttagttggacaatcatgactggctttgatgcactaagacaccgattttcctttatatcgtttaatatttggaatgttttagagtttgtgacttttgtttcaggaaatattggtattgtgttttggcagtacttgaagtggcgccgtgatgaaagtttgtatcgtttgattagagagatgcgtcaggtcgcacgtgaaaattctgacatgacaatttcgtggcgtgctccttatgcgccaacaactcaagcgctgattgatgtatctaatacaattgctgaaaacactcgtcgtattagagaagaagaacgtcagagtgaacgttctaaggatgagatgattaccaatatatctcatgacttgcgaacaccactaaccgctattatcggttatcttggcttggttgaaatgggacaagcattgagtgaaaaggatcgaaaaaagtatattcacacagcgtatagtaagtctaatcaaatgaaggttctagttgaggatttgtttgagtactcacagacacaggcacaagacgccgccttaaatattacgtcactcagtctaaatgatttgtttggccaattacttgctggttatgaattagaagcacaagagaagaatattgcattgaatcaattaacaaatcctgagatgattgttattgaggctgactctgataaattggcacgcgtcttaatgaatttggtttctaatgcgtttaaatacggtgatggagctactttcataaaacttacggcacaaattgatgataaaaatgttgttattcgtgtaacgaatgatggtgtcaagataccagatgaggcaatcggggatatttttgatcgattttatcgtgttgaaagttcgagaaatagtaaaacaggtggcacaggattgggacttgccatcgtgaaggggattgttgtacagcatcatggtagtgtagctgttgagtctgatgatgatatgacttcattcattattacattaccgttgaagcagacatgaggggaatatgttacaaaataaaaagcatcaagtgaaaagaatatggtttattattactgcattagtggttgtattattggctatattttttatggttcctcgtcatgagcaatcaacgcaatcaacaaccaaggtggcaacagtcgatgatcagccggttcaattaaacaccagtgcaacctctgctttagtggttgatttgactacggggcaaattttgggccaaaaaaattcttcaaaacaggtagccattgcttcgcaaagtaaaatgttgacagcgtatggcgtgcttaaaagtattaagtcaggaaaaataaaatggtctacgatggtcccaattactagtaaggcagatttatcgaaagaagacagccatttgttttctcatatcgcgatcaaagctggagacaaagtatcagttcgtgaactttacgatgtcatgtttgctaattctgctaacgatgcggcttttgcattgggtgagtttgtgactcctaaaggggaaacaacacaacaggcactagaatcatgggctaaagaacttcatttgagcggttcacaatggtacaattctgctggacaagttaatgagaatgcttttgaaaatgaaatctcttcggcccctaaaacagcttctaataaagccagtaatcagcaactagctatgattgcacgagctatcttagaattggatccttccctgcgtcaattatcaaaaaaattaacgatttcttatcatatgacgcctaactttgttgtgacagataaaactgattattggcaattaatgactgaaacaatgccaaaccttagtaatcccaaccagttaaccatagaggggcttaagacgggatcttcgcctgaatctggtgctggattcactggtttaattaaagacaaaaacggtcacgaattcataactgtagtcaatggtattgctaattacatggatgaaacaaagcgttatcaagaatctctgcgtattgttgatcaggtattagcacaaaaacagccaaactatattaaagaaaatcaaacagttggccatttaaaaacgttgacgtttccaaatacgaagcaagaacatataattgttaaggctgcacaaacaaggcattattggacaaacaagggtgtaaaattggcatttacacaacctacttttgactcaaagttagccaatataaaaaagaaccaaaccgtgggctatacaacagcagcgttgaatgctcaatatctgccttatgctcaaaaaacagaaaaaaagatttcattaaaatcaacttcctcatcaaaaccagttaattggtttgttaaattttggcgtgatagaacaaaataattgttaaattgaccataattggtctttttttatgtcatcaaatacttctcgaaaaacttgctacaagactagaaaggtgttattatattggtatagaccaaaacggtatagaccaatttgaaagaggttggattatgaacattattagagtaaaagatgttgaacaaagtgcagaaaaagcactcgaaatttatcaaaatgctgtgcaacatggtgcgaaggtactgggtttggcaactggatcaacaccaatacccttatatcaaaaattggcaactagccaaatcaatttttctgaattagtgtcgataaacttggatgaatatcttggcttggatggcgaagacgagcagagctatcgttattttatgactaaacacttatttcaatataaaccatttaaacattcctatgttccagacggtaagtctgaggatcatgaagcagcaattaaagcttatgacagaattattgctgagcatccaatcgatttacaattattgggcattggacgcaatggacacattggttttaatgaaccaggaacatcgtttgattcaactactcatattgtgaatcttacacaatctacagttgccgccaacgctcgtttctttgagaaggagtcggatgtgcccacgcaagcaatttctatgggaattgcttcagtaatgtctgcaaagaaaattttgctgatagccactggagaaagcaaagcagaagcagtggcagctactatcaatggtccaataaccgaagatgtaccagcatctattcttcaaaaacattcagacgttacgatcattattgatgaggcagcagcatcaaagttgtgatagaataaacttgtaaccgatttcataatttttaataggagtaaaaaaatggcacacattacatttgacacaaagaacattgagaattttgttgcagatcatgaacttgatgaaatgcaaccgctaatcaaaatggcggacgagcagcttcgtaatcgaagcggtgctggggcagaatattctgattggattaccttaccaacagattatgataaagacgaatttgcccgcattcaaactgctgctcagaagatccaatctgattcgaaagtcttggttgttattggtattggtggctcatatcttggcgcaaaaatggctgttgatttcttgaatccaatgtttaataatgaattggctgacaatcaacgtcaaggtgttaaaatttattttgctggtaattcaacatctgcttcgtatatcaacgatttggtacgagtaattggtgatcaagacttttcagttaatgttatttcaaagtctgggacaacaacagaaccatcaattgctttccgcgtgttcaaacaattattggaaaagaagtacggtgctgaggccgctaagcaacgtatttatgctacaactgacgcgaaccgcggtgcattacatgatgaagcaaaaatttcaggatacgagacatttacaattcctgatggggttggtggtcgcttttctgtcttaacggcggtcggtcttctaccaattgctgcttccggcgctgacattgaagccttgatgacaggtgctagagatgctcaagaagagtattctgattcagatataaaaaataacgaagcttacaaatatgctgctgttcgtcgtatattgtacgacaagggttatacaactgaactattgatcaactgggaaccaacgatgcaatacttgtctgagtggtggaaacagttgatgggcgagtcagaaggtaagaatcaaaagggcatttatccatcatctgcaaacttctcaacagatttgcattctttgggccaatatattcaagaaggacgtcgtgatttatttgaaacagttgttaaactagataatccagtttcaaatattgatcttcctcatgaagatggcaataatgacgggttgcaataccttgagggcgttacaattgatgaagtaaacacaaaagcttcgcaaggtgttacattggctcacgttgatggcggggtaccaaacttggctgtccacttgccagcacaggatgcctattcattaggatatttgatttacttctttgaaatcgctgttggtgcatcaggatacacattcggtattaaccccttcaaccaaccaggtgttgaagcttacaaaacagcaatgtttgccttattgggtaagcctggttatgaagaacaaacgaaggtttaccgggctcgtctaggaaaataagttaattaatcatattttataacagtatgctcttatcttaagtttaaggtaagagttttttatatgagaaaataaaaaaggcctagtaggccatgataatatgatgaaaaattgattagttattgaaaaaaattttggacagcatgaaaggccatttcggtgccaacaaaataaagcgtgtcaccactttcaatgacagcataaggtccaggcgatactacaagttcttcattatgtaaaatagcgattattgtcgcgccagtattttgccatatattcagattgccaattgattcgccaagttgcttagaagaatctgataagctaaattcataaggcgttagtgggttatgacgctgtacacgttgcgtttggtcaaataaagccgttagggagtcagaaagactatttaaagacgttctttgggtctcaattaaatcgttaatctgatcatgaattgtttgaatattagtagtttcttgggcctgatttaaaaaatattttgctctttcacgtgataatacttcaataccactaccgtgtattggtttaacaatatcgaggtccgataaaatattaatagcctttcgggcagtttcggctgaaacaccaaatgttactgacaaggttgacctagcgtgaagcttggaaccaaccttgtactcattattaacgattttttcagctatttgaaaggctatttttcggtaacgcggttctctgatttttgacatttttatatcctgcaagttcaaaatttgacacaagtgacaatctatgtaaaaattgaagttgtcaattaaagagacaacttgttataaagtataggttgtcactatattttatacggaaattcgaaaagaagcaaggaggagatgtgtgtggtgtcattagaaatgatgtgcatgatgtagtatttttatattacgcggcaccaccactttagaacatgccaaaagtagaaattaagcatctcaccaaaatattcggtaagcgtccaaaagctgcgatgaaaatggtgaagcaaaacaaaagtaagaacgagatcgttgagaagacagggagcacggttggtgtctatgatatcaacatgtccattgaagaaggcgagatttttgtcatcatgggtctttctggttcaggaaaatcaactttaattcgcttgctaaaccgtctgattgaaccaactgcgggtcaattgtttattgacggtcaagaaattactaaattgaataaaaaacagatgatagaaattcgtcgtaaaaaaatgagtatggttttccagaactttgctctatttccacaccgtactttgttagaaaatacagagtatggtttagaaattcaaggtgtaggcaaagaagaacgccgtaaacgagcagaacaagccttagaaaatgccaaattgctatcgtttaaggaccaatatccacaccaattatctggtggtatgcaacaacgagttggtctggctcgtgcactaaccaatgatcctgatatattattgatggatgaagctttttcagcattagatccattagtacgtggtgaaatgcaggatgagttgctagatttacaagctaacgttgaaaaaacaataatctttattactcatgatttgaacgaagcgcttcgtattggtgaccatattgccattatgaaagatggtcgtttacaacaaattggtactggagaagagattcttacgaacccagccaatgattatgtgaaaacattcgtgggtgatgttgatcgttctaaggtattgacggctgatagtattatgatcccagctttaacatcgaacatttatgttgatgggccaactgttgctttgagaaaaatgacagcagaagaagtttcaggccttgttgcagtcaatcgtcaccgtcaacttgaaggctatttgtcatcagaagaggcggttcgcgcacgtcgtgaaaagttgccacttgcagatgttctaacagaaatgccaaagattaaacctgacacgcttatcatggatattatgcctattatttacgatgctcagacacctgtggctgttgtagatgatgataaccgtttgaagggtgttgttattcgtggcgcggtattgaaggcgcttgctgatacagaaggggaagatgacaatgaataatttagtaagtattccaaaaattccacttgaagattgggtcagttcagcggtttcatggttaactactaatttatccggattttttgatgccattcaatctggcggtcaatacataatggatgctttaacaaatggtttaactgctgtacccatgccactaatgattattggtatcacagtaattgccattgttacgacaccgaaaaagattggctttccgttattcacacttttgggacttttgttaattgccaatcaaggactttggtctgacttaatgaataccgttacattggtaatcatggcgtctattgtttcgttgattattggtataccccttggaattttaacagcaaagtcacaaaagactgcggtagttgttcaaccaatcttagactttatgcagactatgccaggatttgtttatttaattcctgctgttgccttctttggaatcggtgtggttcctggtgtgtttgcttcgataatctttgccctaccgccgatggttcgtatgactagtttaggtattcgtcaagttccagttgatttagttgaagcagctgattcatttggatcaactacttggcaaaagttgtttaaattagaacttcctagtgcaaaaaatactattttagcaggcgctaaccaaacaatcatgttggcattgtcgatggttgtcacagcttctatgattggtgcaccaggtcttgggcgtggcgtcttgtctgcggttcaacacgctgatgttggttctggatttgttaacgggcttggattggtgatcttagctattgttattgatcgttttacacaaaagtttaacacccaaccgggacaaaaagcggtgacaaagccatggcgtcgttggacagtacttgcggctttgttggttatgattggtggaggtgttgtcaacactttgacttccgataaaacaacaggtcaaaaagttactattggctatgttgagtgggattcagaagttgcctcttcgaatgtgctggctgaatcattacgtcaacatggatacgatgtcacgttaacgccattagataatgctgttttgtggcagtcgctatctaataatcaaattgatatttcagtttcagcatggttgccagatacacacaaagctttgtatggtaagtacaaaaatgatgtaacattgcttggccctaacttgaaaggtgttaaaactggtttagttgttcctgattatatggatgtaaattccattagtgatttaacaacccaagcaaataagacaatcacaggtattgagccgggggccggtgaaatggccacagctgctaatgctttgaagtcgtattcaaacttatcgggttggaacttatcatcctcatcttctggtgctatggtatcagcattggataaagcttacaaaaataagcaagatgttgtggtgaccggttggtcaccacactggatgtttagtaagtaccacttgaagttcttgtctgatccaaaaaacgtgtttggatctggagaaaccattaatacgattgtgaataagaagtttaaaacttctaaccccaaggcctataaggttgctgataaatttaattggacgaaagatgacatggaatcagtcatgctcgatattcaaaatggtcaaacaccaaagcaggctgctgctaaatggattaagtcacatcaaaagttagttgatagttggtataaataaaaaaataacgctaagctgaaaatcagcctagcgttattttatttgttattctggattgtcatcctcttatcttgttcaacgataaaatggcacaagtctccgtcatcaatacgtgtaggatgttcttttagaaaccgtttgtataggaaagcagtacgtggtttaaaaatcaatgtattgggtgctactaaatcatcactcagtaattgataactgcgaatcgcatacgtcataagttcatgttctcgttgccatgattcttcgcttagtccgtttttttcgacaaacaaatgttgacgttctgcatatcccaaagcttgttgaaatcgatttaaattgttaggatcaatagaagagtcaggtccaatggcaatcattgtttgtttaaaactagctattgcttctggtgttgcgtgtttcgttaattcaaaacgttgaaagggaatgccagtgctagtctgacgttcttcatatttgtaccatttgggatttgttaaaaagtatggtgtattgttcaaatgtgatcctccgtttacttgtggcgcagtcttgatgctagttgtttcataattggttcatcagagtaagatagaacgtttctggcgtaaataccttgaccaaaccatagtagtaagaataatgtgataacagcaatgagtaatgcacttatggctgcaggccatccctcagtatgcgtaacaagacgtattggcatcatactttgagaggcaaatggtatataactaagaatgcgaatcaagagattattcggcatttgagtcatgataaagctaaatacatagccaaccatagcaatcatggaaatgggttgaatagcctgctgaacttgtgcattatcattaattagggaggcaatcattgacgttagcactaagtacagcgcaacagaaacaagaacaaaaattactgcatagattataaatgataatgtcacaccatttaagttagatgctaatccttttacaaaactgttttctttaaagaaattgaaagttgtgaatccggcgatgacgtagattagcagatgtgtggttaccagagcaaaaataccgatgatctttccaaaatattgtacgcgtgcagacgtcgctgccaatagaatttccataatgcgagatgatttttcattggcgattgcatttgcaatcattgatgtataccacatgactataataatagtgatgataccaattgcactggctattaattggttagcgctttcagtattgccactattagttgattgttttgcttgtttgacaacgcttttcaagttataaggttgcactaaatcagcagtttgttcagcagttagtccatattgagtagctttttgggaacgtgataagttacctaatatagcagtaatcttttcttttggaatctgttcacttttaggctgtgtggtaattgtggcttcattcttgttgacggttaacacaccatctaacttttcgttttgcagtgctgtattggcttttttctcattggttatgttggaaacatggatgtctaattccttttccgattgaactaaaatactgcggacttcttggttgccaacaacagcaatattgggtgttgtattgccttgcattttggtaatgccaaatataactgcaccagctaaagcagcgaaaatcaagggagaaatcacaagcatccaataaccgcgtgatttaaattggctgagaaaagtgtctttaataacaataaaaagttgattagtcatgaatagcgacctcctggcggaaaatgtcatcgagtgttggtggttgttggctgaaggctgggatatagccattttttgtaacgaggtcaaacacacggtgcccagcttcctcttctgacaaaattaagtcatagccaacaccatgtggcgtaactgaggcgacaccatcaatagcttttaatgctgcacttgaagtggaggattccacatagacacgtgtgcgaccaaattgttcacggatattttgcacaggaccttggagaacgatttttccacgttttaacatagttagatcgtcagaaatcttggttacgttgttcatgtcgtgacttgaaaaaataatcattgcaccattatcacgtaagcgtatgatttcatccatcattaagcttgtattgacaggatctaaaccagaaaaaggttcgtcgagtatgagtagactgggttcaaagattaatgaagcgatcatttgaactttttgtgcgtttcctttggaaagtgattgtactttatcacttactttaccaacgacatcaaggcgtttcatccaatctttcaatgcaacgcgggcatctgaacgtttcataccgtgtaattctgcaaagtacaatatttgttcttcaacggtccgtttttggtataaaccacgttcttcgggtaagaaaccaatacgctgtttatcattttgggtaatttgctggtcgttccaagtgattgttcctgatgttggtttaatgaagtttaaaagcatacggaaggtggtcgttttaccagcaccgttttgcccaatgagtcccattacttttccttcagtaagcgtcatattcatattagagacagcaatgttttgtccgaacgtcttgttaagattagtcagttgaatcatatttttattccttataatattttatttagtatatatcgcacaccactattgaacaaataaattaagacaattaagagatatagatatgcagctcttcggtcccaataaaaagttgcccagcaaatagcaatataacttacaattagtaacataataaaagttattgtatttgcgcggtgagtaatttcttgcagtcgttcgtctgttgcctttattttgcttttgtgtagatacttgcgattatgaaatagtattctagatgtaattatggtaccgatacccccgccaagtataccggatgaaaatccacgtagaaaacttcgcgaagctggtgacttttgcaagcttgctaaaagcattgtaatagccacagtcaatatgataacgattgtcaaaaaattaacttgatacttgatttttgcacgatattcgtcgtcagttattcctggttttgttgatgcgaatagtttattaatcattttttcccccttcaaaaataaagacatcttcaatcggtaagtcaaagaactcggcaattcgatgtgccaaaaacaaagaggcattatatttacctttttcgagtgatatcacggtctgacgcgttacctcaagttcagcagcaagctctgcttgagttaatttacgtgattttcttagttcttgaatacgatttatcaaagtatgcctcctatagtttggctattcaacaaaaatagtatagcgtactttacattaaatgtaaagttttgattacattttgaaaaggttgcatttataggaaataagaactataactaaggtatagaaaagggggccgaaacatggctgatgaaaaatttgaaacattggatcttccaatgagcgaagtctttagttggagcgaggacaaaaccccactacgcgatgcattgtggaaccattatatggacacaagcaacaaaaacactttggaaactttgaaacacttgaaggcttatgaaagcatgagttctgatgaagttaagcttgaagctgaaaaagtattgcaagaagcataatcggataaaaagagattgatattgtttcaatctttttttgttggaaaaaccattgacgcatgctggttttttcggtatacttaatatttgttatggcgctatggtcaagtggttaagacgtcggcttctcaggccgaaatcgagggttcgactccctctagcgctattagtatatttcatggcgttgcataaggtttcaaaaaccttgatgtagcgccttttcttatgaaaaacgttgcattgtatttcgtaataaattggaaacattataaatacgcaagtaggcagtataacggcatataagccgttttttatttgtagaaaaggaagtgagtaatagtatggaatttttaggattagttattagcttagctgatgaactatttgatgtagacgataataagccatttggctttaaattttggctgtctatatttgtatggttaatcatgcttagtgggtttatagttgtagctacagtatttataattttatttccagctgtgtttttaaaaatcctacatactatttggcttgcggtgatgggtatagaaatattgttagcatggttttgttattattctggtaaacgtgtagtaatatgggcatttcaaattaaaaataatatacaagcacactgtaagtaagtgttgcatcaatttttaataaatgatctacgagcttggaaagctggtctatgttttagcgtatatctgttatttattaatttaatcaaccaatgtcaattaattacttttatctacacttaaaaacctgtacacaaaaaagcccctgattaattttaggagttttttactatcgataaatatacagatggcagtatagtttttgagcaacagatagaatgatgagtgggctaactaatatgtatgcctcacataacataggtgttccctatgtatctaaagctcactatgaaaacaataatggcgataaccgccactgctgctctcaattgaaatgttttacttttggtatctatcctgttcatattatgttgctttctaaaatgttcatattctgattcagcatcaaaaacttgtttattttggggtacctaaaacagtcttaaaaaccgatcattccatatgttctcataaaattgcacagtttgttttgcactcatgtagtaattgtctaatgtggtgctaagtccttttttcatttgcaattcatagcccaaaccgtgtgccattttgattgtggtgtcaacacaaaactctgtttgagcaccacaaatttcaatgctacgaacatcgttttcgttgagtagttttcttagtttagtgtgatagaaagaattggcatgtgttttctgaatgaaataatcatttggttgactatcaatttcggggatgattttccaaagaaagcttccaaatattaattcttcgtcgttatgttggataaaaataatcggtttatgtgcatgacgataagccgtaatgcgactgtttataccagtcacacattcttgaatgttaaaaatgtcctgcggctctttacaaacgccattttgaaaatcaataactagtagtgtgtctgatattggtaacatcatttttccttcttttaagttaagtgttcaaatttagggagccactaaacgaatagaaagacgtattatagtccaatattattcgttttctttcacttactcttatcatgaactaatacattagtatcttcgtaaataagctatttgaattacaacgttatattaacacattaaaaaaacatatgttgatgcacgaataaagtagctgcgtattttaaaggtttgttaaatacataagttgcggtgccagtgacattaattttgtacaagcactggtacgtcataaaattttttttcttatatattatcaaaaaaaggccaatcaatatcgttattgatcggtcttttttatatcaagttgagatgaatatacgaacaaatggtgataatttttagaactagtagataggaggtattgctttgcgttgtgcaatgtgaacaaatttaacataattattgtttaattgatttataacgtgtatgatgtattttaacacctagttaattttatgattataataatgttatttaaccggttaataactttataaattaatatataaaatattgttctttattaggttcttataattttaatttcatcgatgaagtaggaggcgttttatgaataatttttttcaaccacaccttatatgggaatatttgcctgatgtattgtcagcattaccgacaacgctgttgcttactctagtatcaacaatcattggcgtaatcgtcggcgcaggcattgcgtttgtcaaaatggaagatacaccaatctttaaacaaattgcagtagtcttcacttcttttattagagggacaccaattttgatacaaatgtttttagtttattatggactgccgatgtttctaggatatgtgggcattaacacagatgatgtcagcccattgatctatttatttattacatatggattgaatatggcggcttttctttcagaaatcattcgtgccgcattggaaagcgtgccagcaagtcaacgtgaagcggctttaacttcaggttacacaaagcgtcagatgtattttaaaattattttccctcaggcagtaattattgcggtgcccagttttgcgacaatggtcatttcgttgctgcaagatacatcattggcattcacaatcggtgtattagatgttgttggtaaagccaaagcattgggtacggcgacctttcacacagttgaggcttacattagtgcgatgatcatatttgttattttaagtttcatcttagaaagattcttccgctggattgaaaagcgcagtaacttcacgtcacgcaaaacagcaattttggctaataatcctgtaataccagtcattgagacgccaaaaacaacttaatacatacacaagatgttgataaatgagaagagaattagaggagtaatattatgcagaacaaagcaagtcgtagcaagggcctatggattggcattattgtagtcgtggtagcagttattgcggtcgcattattacacaataacggaaaaagcagtggatcatcttctaaagtacagacaattaaagttggttccggtaacgatgctcaaccctttgcatatttagataaaagtggaaaaccagttggtatggatattgctttgatccaagccatcgataaaaagttaccacaatataaattcaagctaacactatctgattttcctacgttaatcacaaacttgaagagtggtaagacaacgatggctatggaacagatcgaacagaatacagaacgaaagcaagactttaagtttggaagcgttggctatactgtctgggataccttgttggctacaaagaaatcaaccggcgttttgaactcatttgcggatgcaaaaggaaagaagctttatgttactaattcaacgaaccaagcaactctaacagatgcttacctaaagaaaaatcctaatgcatattcagttgtacgtggaacctacacaatggagcaagttgcgcaaggaatcaattctaaccagtttaacgtttacccagctcctaagtattcaattgatttgttgaatcgtcaattcaaaacgaaattagtctatggaaaagctgttaaccattctaacgcttatccaatgtttaataaaaaggctgatccaaaattggttaaggctgttaacaaggcaatggaagaattgaagaaggatggcacaattaagaagttgagtaataagtggttaaagggcgattatgtacctaaggattagtggaggatttcaatgaactttgatattggatttatatttcaagtggtagttaaattaattccatacatccccatcacgatttacatggcgtttgttagtttaattcttggcggattattaggattagtcatcgcactagtacgacactataaagtgccggtattatcacagttgtttaccatcatgattaccattcttaaaggcgttcccttgattttagtttttttacttatcttcatggttacttcccagaattttaatcgtgtggctaaagcactaggatggcatatgcactatggtgatttaccaatgagccttctagcaatcattgggttatccttgatggcaatggttggtctgagtgaggcattccgaggtgcttttgagtcagtgaaaactgttcagtttgacgctgcacgatcacttggtatgaccaacttgcagacaattcgtcgtgtgttaataccccaagcatttccagtcgctttaccaatgattattaatatgttgattaacttaatcaaaggtacagcaattgcatcattaatttctgtggttgaaattttctcaacggcaacgcaagccgctagttctaactataaatattttgaagcttacattgctgcggcaatcatttactggttaatgacaattgttattgaacgagctgctgttctattagaaggacgtatggataaaaagacaaggagggcgtaataatgattgaagttaaggatgtccataaaagtttcaatgataatgaggtcattaagggcgttagcttgtctttaaatgagggtgaggtagtgaccattctagggccatctgggtctggaaaaacaaccttcctacgttgtttaaattttttggaaacagccgattcaggatcaataacggtaaatgatgaacaagttacatttggtcaagcaaatgcgaatgatattctacagttgcgacgacaaatggggatggtatttcaaaactatgcgttgttcttaaacaaaactgcaaagcaaaacatcatggaacccatggttattgttcatggatttagtgttaaagaggctgaagtgcgtgccgctgaattattggaagctgtcggtttaccagatcatggtgattattacccagcacaattatcaggtggacaaaaacaacgtatcggtatcgcacgagcattggcagtccacccagcggtattactgtttgatgaaccaacagcggcattagacccagaacttgtgggcgaagtgcttaaagtcatgaaaggggttaaagatgccggtgtagccatgattgtagtgacacatgaaatgcaatttgcgtacgaagtgagtgaccgggttatttttatggccgatggcgtgattgtggaggaaggaacgccgcaacagatatttgaaacaccgaaagaagaacgaacaaaagcattcttaaaccgttttacagtacaataagcaattaataattttaaaggagactgcgtaatatgtcagaaaagcgttatgaatttgcaacacgggtagcaggattgctcccaaatcctttgcgggaacaagccaaacatgttcaagaggctgatgattatattaaactaacttatggttatcctagcaatcaggcctttcctgttgaaaagttggccaaaatttctgaaaaaatttaccgtgatcacgcatttgactttatgcagtatggtgaaaccgaagggattccgagattaagagcacaaattaaagaaagattagcaaaataccagtctttagatgttgaaaataatgatgttttgattacttctggttcgacgcaaggaatggatttggtttttaaaatatttgtgaatgaaggtgatattgttctaactgaagaacaaacatttgttggcgcagttaatgcgattaaatcttacgggggcacggtgcaagggttaccatttgatttctcggctggaagtattgatacatcagccttgaaagccacacttgaagcggacacggagcataggattaaagtgttgtacttaatcccaacttttcaaaatccgattggcacatcaatgccacttgaaaaacgtcaagaagtatatgatatatgtcaggcacatgaagtcatgatttatgaggatgatccatacggtgatttgctgtatgcagaaaaaacagccattccaaaaattaaatcatttgatcagacgggtaatgtcatttacgcaggttctttttcaaaaatattagcgccaggatcacgtttgggatacttattagcaccaaaagacgtattcgataaattagttttgatgaaacaagttgccgattcgtttgccaatttatattggcaatatttggctagtcagttgatagacgattacgactttaatgaacatattgattacttacgccagctttataaggaaaaaatggacacaatggtttcatcgctagcccaaaagtctgatgataatatggcatttgttgtaccagatggtggttatttcatatcagttaaactaaatgacgatatagaaaccgaagcattttatgacgaattggaacagcgccatatcggtgtcattccaggcaatattatgagtgcagcaggtagcggttatgagcaatactttagattgaactttacgttacccacattatctgaaatcaaaattggcattgaaagaatttctgaggcagcagcggcggcaaaacaaactaagtccccagtaatttgagagacgggcatatgaaaatactattttttaacgtctcagctgtagagaaaaatattatcgatgaatgggctgacacacaactgatttctgttaaaacgttacctgtttcgattgactacgataacattgatttaactcgcgattttgatgctgttattttttatccaggaaaatcttttcaaactgatgaaaagttatatgctcgattggcagagaatggtatgaaacaaatttctgtcaaatcaacaggttatgataatattaatttcgaatttgctgaaaaatatcacctgacaataactaatgttcctgattattcgccagaatctgtatcgcattttacagtgatgagcgcgctcatgttgttacgtaatttaccgcgatatcttgatagcccagaaacgacacagcgaaaagagtttttgggaagagaattgacagaagtaaccgtgggcatatatggtgctggtcgattgggcagtcttgtggctaagacgctgaaattcatgggtgcacgggtaatgatgaattctcgtagtctgaagccagagttaattggatcaggcatagaatttgttgattttaaacagttattagttgaaagcgatgtgttgagcattcacgtgccactaaataaacaaactttccataaatttgactttgataatcttagtttaatgaaacaaaatgccatattaattaacacagctcgaggtgagatagttgatacatcagcactgataacgcacttacagcaaggaaaatttcaaggtttggcacttgatgcattggaagatgaggatacgaaaggatttgcaacaaatccctattaccagtcacttaataaatttgagaatgtattgctgacaccgcatattgcgtattttacgaaggcagctgttcgtgatattgcaataaccgcattagaaaatgcacgtgatattgttattgaaggtaaatcagagaatactgttgtacaataggaggtaagcaatgagttttattgaaattaaagatgtacacaagtccttttaccaaaaagaaattttaaagggtattgatctaaccttgcataaaggtgaagttattgttatcttgggcccatcaggttctggtaaaacaactttcttacgctgtttgaatacacttgaaaaagcagacaaaggacagattaagatcgatgatgtgacaaaagattttacagtaaaagatcgtcaaaatacacgagacctaattttaaagacagcgatggtttttcaagggcatgctttatttgataatatgacggtattgcaaaatgttattgaaggtttgattcgtgtgaaaaaaatggatcgcgaagcggccacaaaaattgggttgtcaactttagacagagttgggctatctgaccgagcaaattattatcctgttcaactctctggtgggcaacagcagcgtgcagggattgctcgagcaatggcgatgcagccagaactattattgtttgatgaaccaacgagtgctttggatcctgaattagtaggtgaagttttatccgctatgaaagagttggcacaagaagggcacacgatgattgtcgtcacacatgaaatgcaatttgcttatgaagtggcagatcgggtattatacatggaaggtggcgttgtggtagagcaaggtccaccagaagaaatatttaatgcaccaaaagataagcggactcaacaatttttggcacgactatcgggtaaaaattttggagagccagaattggtaaattcatgatgcagaataatcaacaaagtttggacaaagtaaaaggcgcagtcagtactcaaagcagagatactgatcagcgtctttttaccaaggattttatcattctaatgatgattaactttttggttatgacagcagtcactactcaaatgggtacgctgccactttatgtaacccatttaggtggtaattcgattatgtcgggattagttgtcggtatttggggattggctgctctttgtgcgagaattccagttggcaagttactggacacatacggtcgaaaaaaattaatttttattggtttagcaattttgatggctgatttttctatgttgattttttatagtacaattgctagtttaattgttttaagagcgctacaagggattggtaatggtacccaatctacgtcggttgcaactatggtagctgataagttaccgaagcaaaagttatcaattggtttggggtattttagtatatcgcaaactttaccagccgccattggtcctgcaatagggttagttgttgttgaaaattttggatttcaatcacttttctattttagtttgtcactgatttgtctagcgtttgttttatcatttttcgttaaagataattatactcatgttgaaaaatctaagcatgtagcagatgagaatacaggctttcttgatttaattcgtctaaaaagtgtgtgggtgccaagtctaattgtttttgtggtttgtttcgcaaatgctgctgttacagcgtttttagtccaatttggtgagcaaaaaaatttatcagcgacgattgttgggtttagctttactatgcaggcgattattggtgctttagttcgtgtttggtttgcgaagttatatctatactttagatcttatgtgttagtaatagccggtatattaatgattgcctcagcctattttatgattgcttttggtgcaacggtggaatggttagttttagccggtgctttgaatggatttggatttgcattacttattccgttgatgaatgcagtggttttgaagaatgtttcctcagcacaacgtggtcgggcaacggcaattttttcctctggtacggatgtcgcctatggcttaggggcttttatgtggggtgtagttgccaattttatcggtttctttggaatgtattgtctcacggctacaatggtcattgcaactttgttgttagtaatcgcccataatcgtttgttaaatgaataaaaaagagaagagggcggtaccatgcccgaggtgttgattaagttgacagtgttcggatttttcacgtacaatagtaaagtatcaaattaccattttcgtggtaatttcaacatgaaatggtcgatacgttgctagaaatggagaagaaacatggcaaatgaaaaacatcctgcagtatggtatgaacaccttcatactgaaaagtatacaggtgctcgacgaggtcgtattcacacgccacatggtacgtttgaaacaccgatgtttatgcctgttggcacacaaggtgctgtgaaaggcgtgggcacgcgtgaattaaaagacattggttcacaattcattttaagcaatacatatcatttatgggtacgtccaggagatgaattaattgctgaagcaggcggtttacataaatatatgggatgggatcaggctatcttgactgattctggtggctttcaagttttttcattgtccgatgcacgtaaattaaaagaagaaggcgtaactttccagaatcatgttaatggtgacagaatgttcctatcacctgaagtagccatgcggattcaaaacaaccttggatctgatgttatgatgcagctagacgaagccattccttattttgaaacatatgattatatcaagaattcaatgcaacgctcgctgcggtgggctgagcgagccaaagtagcgcataagaagacagatacgcaagctttatttggtattgttcaaggagcaggttttaaagctttacgaactgaatcggccaataacttggtggatatggatttacccggatacgcagttggtggtctatcagtaggtgagtctaaagctgaaatgaatcgggttctggacttcactatgcccctgttaccagaagataagccacgttacttgatgggcgtggcagcaccagattcattgatagacggtgtgatgcgcggtgttgatatgtttgattgtgtcttaccaactagaataggacgcaagggaacgttgatgacacgttacggtcgtgttgtcatccgaaattcaaaatataagaatgatttcacgccattagatcctgatttgagttattactcaccaaatcctattcgtaaggaacaatttggcaatttagcacaatacgatataccaggttataatccttttaaaacattaactcgttcttatttgcatcacctatttaatgcaaatgaattattaggtgcgcaattagcttcggaacataatttgcggttcttgttacaattcatggaagatatgcgtactgctattgaaaacgatgaactattggctttccgtgaaactgttatggaagaatatggatataataagcctaatgcacgattattctaagtttggtataataatagtattagcaaaatgagtaaaagttaccgtgaaatggaacgcgtagctaaactcgcttaggaaagtaggagttagaatgtcgttgaatttgattttgccattagtaattattgtggcaatgttctggtttatgtcacgtcagcaaaagaagcaacgtgagcaacaacaaaatatgcaaaaaagtttgcaaaaaggtagcaaagttgttaccattggtggtttgcacgcagttgttgatagcgtggataatgctgcaaagactgttgatttagatgctgaaggtgttattttaacatatgaattatcagctattcgttctatcagcaatccagtagatactgaaaagccaactgtggctgatattacacctgctgataaggtcgaagaaacaagtgaaaaaattactgacgatgctgaaaagccagcagatgacaagtaatatatagtggcagtataataaaaggaagcgtaagcttccttttattatggagaaaatatgaaaacagtcacaaaagttatgtcggatggtacaaaaattgtatatgatgaatacggtaatgatcagttgaagactgtttttttattacatggtaatggtagctcagcccactattttaaacgtcaattacccagttatacagcgtactttcacgttattgcaatagattctcgaggacacggtcgttccaccaatactaaaaaatctattgatatggcagatgtgattcgtgatatcgatgaattgagacgagagctgtctatcgataaaataatcatagttggttatagtgatggcgctaatattgcattgaaatatgccgttgaaaatcagaatcatgtttctagaatggttttgaacgcacctaatgtaacagcagatggtgtttatcgtattttatggtggggggatgctattgcacgatttggaactgaattattttcaccaattagtcagaaagctcgtcgccgtcatatgcaactacatgtcatgagtgaaccattgaatattacacgggcacaattaaaggtgttaacaataccgatattatttgttattgggcaatttgatatcgttaaacggcaacacattgaaagtatttccaaaattatgccggttgccaaagttatgatcctgcgtgggcatgggcatttcgtaacctacacaaatccgcggaagtttgcacagttgattacaccatttttacttgggggaaagcatgaagggcattaatcacgttttatcaaagttaattatattagttattacactagtgctgattactcagctgttcattatgacacgagaaatcacgtggcatgcaattttgtcaacaatgaatgatattgcttggtggcaaatggtgttgctacttatagctggatttttggtgatcatgtcaatgttattcaatgatcttattttgcgcgaatggcaaggctacggactaactacgagtgaagtgttacagcgtgcgtggttagttaatgtttttaacttaaatgctggttttattggtattttaagtgtatttttacgacgtattttttataatgatcaaccaaaacaaaagccgattaagccgtatatacaaatgtacatactcggtcaaagtggtctactcttcgcaactgtcgttgcttttgtcattttaatattagatgccaataaacaattaactgaacaattagtgtggttagccctgtttattttagtggctatcatagggataattgtttcctttagtaagcggataaatatttggcaaagtttaaacagcacagttgttgcacgttttataattaactcagttattacgctgttcgctcaagtggggttgtttatattaataggtcgtattattgacattgatattggtccttcagaaatcatacttagttttattatttctagtgcaattgctctgattaccatgacacccggaacttggggttcgtttgacattgcgattattattatgttgtcgttctttgatgtagctcgtgtggatagttttatttggctcatattatatcgtgttagttataatttgtttcctttattgagcgctgtggctcttttgtttttacgtatttctaaacgaattaatgctagttttcgaggtgtaccgcattatgttgcccaatcagttgttcaccaatttttgattattatactctatttatctggtatgttgcttgtcttagcagggacgatgcccaaagttgcagaacaaatatttgtttttaatcacctacgttcttggccggtcacatatactttaatcaaccaattacccaatattttatttggttttttgatcctaattagtgcccgtggcattgctaatcgtgtacaacgcgcttatggggcgactattgttgtcttattgctagtagctacatacgtatttttcttttatcagtatgtggcaccgttgttttttatagccgttattttgatagcggtgttatttagtaaaaagtctctgtatagaaagcaatttattcactcttgggaagagcaggctgtggattttctgatttgggcgacgctaattattagttatttggctttgggcgtggttaatctacctccaattcatcgccattttcgtcatgttggcaacatgccatccatgcattggtggtacgtaggtcttattattatcagtgttgtctctgtttctggtttagctttgtctaaatttttgcattcacagcagatcccgcttggtgtggggttagatgaagcaagagtgaacaaagttctgactattggtgataatcactacactaatctcgtttttttgggggataaaagactatatttttatcgaattgatgatgaagatgttgtgggtattcagtttcgaattattaacaacaaggcgatggttatgggggacccttttgggaacgaaaagtactttgctgctgcgatggagcaatttgtaaacgaagcggacgtacttggttatatgccagttttttatgaaattagcgaaaacattgccatgatggctcatgaatttggttatgatttttttaaacttggtgaggaagcattagttattcttgatgatttttcgactgctggtaaaaaaatgcagaatattcgttcagaaatgaatcaagcaacgcgtgctggtttcaaattcaaggtattagaaccaccatttaagcatgacgtgttgcagcaaatgcaactaattagtgatgaatggcttgctggacgtgaagaaaaaggatattcactcggattctttgatgaaaattatttgcagcgtggtccaatagctgtacttgaaaaagaaggacaaatcgaagcgtttgcaacgttagtgacttcatatacagaacaacaaatgacggttgacttaatgagatttacgcatgctgctccgaatggtgtcatggatgttttattcgtcaacgtatttgattatgctaaacagcggcattttaaaatatttaatttaggtatgtcacctttggctaatgttggccagcatcgtcaaagttttggacgtgagcgcttggctaatttggtctatcaatttggttcaaaggtttattcctttgaaggattgcatcattataaaaataaatttaccaaagtttggcaacctatgtacattggctactcaagaaaaagtagcattattgccgttatgtttggattgctgaaaatagacaacaaaggagtgaaacatgcaccaaaaagcgatatgagatatactagaagcaattaaaataggaggaaaaacatttaggatagcgttataatttgctaaatgttctgatagttaatggcaatgcatcaatatttcatgggaatgagtcagcttgaactcattaaccgagctccaggtttttttaaatatcagccccatagtgtagcggcacattcatggaaagtaactcaaattgctcaatttttagccgatgtcgaggaacaaaatggcgctcaaattaattggaaatcagtttatgaaaaagctttaaatcacgattatacagaaagatttatcggcgacattaaaacaccagtgaaatatgcgacgtcaacattgcgttccatgttagctgatgttgaagaatcaatgactgaaaactttattaaaacagaaattcctgaacaatttcaagccgcatacacacgacgcctaggcgaagggaaagatgacacgattgagggcaaaattttatctatttctgataaaattgatcttctctatgaagcatacggtgaattagaaaagtttaaccctgaacccgtttttgtgaatatttttcaaagcagcttggaagcgctcgccgaatttaaagatatggccagtgtgaagtatttggcaaaagaaatattaccagaagtttttaaagaagatttcattcataaggatgtattgtttgacctagctaaaagtttgttacctgattttgccgaggtggttaataattaatatggaaaaaaattacattgcgcgcatgcgtgaaaaagttgggcacgaaggcatgatatttgtctctgcatttggcgtattgtggaacgacgcacatgacgcaatattactagaaaaacgttgggactccgatgaaggctggggcttccctggtggttatcttgagtatggcgactcaccaatgcaggctgttacacgagaatttaaagaagaaactaaccttgatgttaaagttactcgtatgttagggatcgccacaaatgaggttaaaaaaaattcttggggtgatgcgcaagaaaccattggaattggttttgaagttgagcatgttggtggtgagatgttgaaagatggtactgaaacgcttgatttacaatttgtgcctgttcatccagaacctaaaatgttcgtcccacaagcacaaaaaacaatgcatcttatattgacgcaaaacgagattagtgaacaaccttggatgagggagaaaaacgaatgaaactttatgttgtacgtcatggtcagaccatatttaatacattaaacaaagtgcagggatgggctgatacaccgctaaccaagaaaggtgaaaaagatggccaggaagctgggaaaagattaaaaaacgtagcttttgacgtagctttttcttctgatacttcacgtgctatgcatacggcagaatatatcctagctgaaaatatccacgagcatactaagctacaaattacaccagagtggcgtgaatactttttcggtagctttgagggtggtagtaatgatgtgatgtggggtgctgtggctaaagaatttggcgtaaataaaggcacaccagatgctattgctgcagaagttcaagacatgacagcgattatgaataaaatttacgaagtggatccagagcatctaggtgagaacgccacacgtttttggcaaagaatagacgctgcattggaaaaactcctgatgacacaaaaagccaatgctaatgtcttgttagttacgcacggtcagctcattggtaatttggcacagcactatggccattttctcggggccgaaagacccaaaaatggtgctgtggcagttttcaatcttgatgacgacggtttgcaagtggaactttttaatgatgttaacaccgtattttgataaaatatggttaatattttatatttttttaaggattaaatttagccaaacaaatcgtttaatgataatgttttcattgttgtttcagaaaacatactcgttattttcttcacaaaaattgtattaaacgattgacattttatggtggaaccggttacaatattatggtaagcgattatcataattgaaggagataatatggttaaacaagatagcctgctcactaaaattgcttttttgggcatttcatttgtcttgacaagtgcatacgctattaacggcgcattgccacaaatgacagaggcgttgcatatttcatccaccgaagcgcaagtgctggccactacaccttctattactgtgactatttttgttcttttgagtagctttatagctgctaaattaggtgataaaaatacaatcattttaggtgtaacattggtcggaattgctggaatgataccattttttaccgattcatatgtgatcattttagcatcacgaacggtgttaggtgctggatttggtattttcaactcactggcagtgtccatgattgctgtgatgtacaacggaaaaacacgttcttcgatgctcggataccgtgcagctgctgaacaagttggacaagctgtattaacattgttagcaggattgatgttagcgtttggttggcacgcaacatttttggtatacctaattgcatttccgattttgttcttgttcattaagcgggttcctgatacatcagaaatgacaccgcttaagacagaaacgacggacagtacacaggtagaagaggtaactcgtattagtccattggtattggtactgacactctttgctgctttccttgttattgattatatggccattcaacttagctttccatttatggcggctgacttgaagggcgacggatacaatacctcaccaatattgtcagctatgctgattgcagcaacaattggtggtgtaacatatggttggtttatggcaaagtttggtcgtttcacactacaaattggattagtattaatggcgatttcaaatttcttggtcgcattttcaaatggtaactttggtatgttgattttaggcgttttattaataggattccccctacaattaatttcaccatttatttttaatcaattaccaaagttggcaccacttgcacgtcagtcattggtaacgtcaatcatattaatcggatttaacgttggtgtattcattgaaccgattgtagttgcagcttttgcaaagatgattggtcatggtggtggtagcgctgcttcttcagcatatgctactattccatatctgggttcggtacttcttattatcgcaattattacagttataactaatagaaaacaggagaaataactatggaaattcaaaataaagcaatgctcatcacatacgctgattcattgggtaaaaacttgaaggatgttcgcaaagtcttgaaagaagatattggtgatgcaattggtggtgttcacttgttgccatttttcccatcaacgggagaccgcggttttgcaccttctgattacacacgtgttgattcagcatttggtgattggagtgatgtagaagcattaggtgaagaatattacttgatgtttgatttcatgattaaccatatttcacgtgaatctgttatgtatcaagatttcaagaagaatcatgatgaatcaaaatataaggatttcttcattcgctgggaaaagttctgggccaaggctggtgaaaaccgtccaacacaagccgatgttgacttgatttacaagcgtaaggataaggcaccaactcaagaaattacttttgatgatggtacaactgaaaacttgtggaacacatttggtgatgaacaaattgatatcgatgtaaactcagctatcgctaaagaatttatcaagacaacgcttgaagacatggtgaagcatggagctaacttgattcgtttggatgcctttgcatacgctgttaaaaaagttgatacaaatgacttcttcgttgaacctgaaatctgggacacattgaacgaggttcgtgaaattttgacacctttgaaggccgaaattttgccagaaatccatgaacactattcaattcctaagaagatcaatgatcatggttacttcacatatgattttgctttgccaatgactacactttatacattgtattcaggtaaaacaaatcaattggctaaatggttgaagatgtcaccaatgaagcaatttactactttggatacgcacgacggtataggtgttgttgatgcgcgtgacgtcttgactgatgaagaaattgattatgcatctgaagagttatacaaagttggtgctaacgtgaagaagacttactcttctgcttcatacaacaacttggatatctaccaaatcaactcaacatattactcagctttgggaaatgatgatgctgcatacttgctaagccgtatcttccaagtgttcgctcctggtattccacaaatctactatgttggtttgttggccggtgaaaatgatattgaattacttgaatcttcaaaagaaggtcgtaacatcaaccgtcattactactcagttgatgaagttaaggaagaagttaagcgcccagttgttgctaagttgttgaagcttttgtcatggcgtaacaactttgctgcatttgatttggacggatcaattgacgttgaaacaccatctgatacaactatcaagattactcgtaaggataagtctggtgaaaatgttgcagtcttggttgccaacgctgccgataagacattcacaatcactgcaaatggtgaagaaatcttagccaacacagaagctgataagcaacaattgtaattttaaatatatgaatgattaaaaaatcagtacgaagagtactggttttttatgtacttaaaaatagtgaataattggtatattttacattgacaggcaaagtaatctttcctatactagttgcgtgttaaatagttgaaaaatagtattcgatagcgtaatattagtttttaatgtcttgaaagaggaaatgaaatgcaaattttaaaagaacatgcaaagccttatgctcgtgatattatgttttcaattattgcggtggtgataatggctgttgcatcattgtggcaaccacgattgcttcagcaagttatgaaagcaattatcgctgatgatcaaaataaggttgttgcttacggatttcaactgttatttttagctttaatcggattggttgctggtgtaattaatacaatttttgcctccaaagtttcacaggcgattgctgcagatattcgtgcacacgagtataaaaaaatacaatcattttcatttggtaatattgaaaaattttcagcgggtaacttggttgtccgtatgacaaatgatgtcaatcaagtgcagcaattaatcatgatgattttacagtctttgacacgcattccaatattgtttgttggagcctttattttggcattgattacattgccacgtttatggtggattgtaattttaatggttgtactgatttttgtatcttcgcaagtgatttttaaacaaatggggaagtttttctccaaaattcaaacattaattgataagacgaatacgttggccaaggaaaatcttcagggtgttcgtgttgtcaagtcttttaaccaagaaaaaaatgaaacaaaccgttttacggataattccaatgagttgacgcatgtcaacacgactgttggctatttattttcgactatgatgccgatgttcatgttgatatcttatgttgctatcggtacagctattttattcgtaggtcgcgatgttgtcaaacatcccaatgatttagttgcgattgcttcttttacttcatatttaatgcaaatattctttgccattatgattggtggtatgatggctacctttgcatctcgtggttttgtctcgctaagacgtattaaagaaattttagatacgaccccagacttaacgtacgctcaagatgcgcctgatcgtgatttgaatggaaatatttcattcaaaaatgtttctttcacctatcctggagatactaaaccagctttgaaaaacgtatcgtttgatatcaaagcaggtgagatgatcggtatcgttggtgcaactggatcaggtaaaacaacacttgcccaattaatcccaagattgtatgatcctactgaaggtgtggtagctgttggtggtgtggatctcaaagcagtaaacgaaaagtcgttgcgagctgcggtttcgtttgttctacaaaaggccatattgtttagtggtacgattgcagcaaatttgcgtcaaggtaaaaaagacgctaatgaaaaggatttccaaaaagctgttgaaattgcacaggctgcggagtttgttaatcgttatgaagataattttgaccacattgttgaagagcgttctgccaatttttccggtggtcaaaaacaacgtctttctatagcaagaggtgttgttggtagtcctaaaatattgattttagatgattcaacatcggctttagatgctcgatccgaaaagctggttcaagaagcacttgaccaggaattaaaaggaacgacaacaattgtaattgctgaaaaaatcagttcagttattcatgccaaccgcattttagtaatggatgagggtaaggtagtaggcatcggtgcacatcatgagttgcttgaaacttcaccggtctatgctgaaatttatcaaacacagaaagcgaaaggggcagaataatgacagatattaaacacgcaattaaatattttgcaaagtatcttaagcgttattggttagcattgtctttcgtagttgttgtgacaatagcctcaacttatttccaagttaaagcaccagtttatatgggaaaggcaattacagaattatcgacttatttaggtcaatacttgaatcctcaaacgcatgctgttgctagcaaaacacctttctatcatgcgctggaagcaatgatgattttctttactttaactgcagtaacaatgttcatttctagttttatatctagtcgtattagttcagaggcatcaggccggatgagaattggtctatttgctaaattgcaacggatgacgattaaatattttgacacgcatcaagatggcgaaattttatctttgtttacgtctgatttagataatatttttaacgcgatgaaccaggccattttccaacttttatcacaattcgctttgtttgttggtatcattattatgatgtttcagcagaacgtcaaattagcatgggtaactatggcttcaacaccagttgctattattgtcgcctggtttgtgatcagtcgtgctagaaaatatattgacacgcagcaagatgaaactggacgcatgaatggttatattaatgagcaaatcaatggtgagaagattattattacgcaaggattgcaacaagaatcaatcgctaattttggtccgtataatgaacgagtgaagcaagctacttttaaaggacagatgtattctggtatgctgtttcctctaatgcaaggcttgtcattgttgaacttagctattgtgattttctttgggtcatggttaattgttcatgacggtatggataagtcggttggtttgggattaattgtggtgtttgttaactattcacaacagtattaccaaccaatcacacaaattacatctatttataatatgttgcagttagctgttactggtgcaagacgcttgagcgatgtccatgaacaagctgaagaagttaaccccgaaagtggtcagaaattaactaatctaaagtcgggtgttaccctagaaaatattcactttggatacaatgatgacaaagaaattcttcacggtgtttcaattgacgttaaaaaaggggaaatgatagcccttgttggtccgaccggctcaggaaagacaacggtcatgaacttattgaatcgattttatgatgtgactgaaggatccgtaaagtttgatggcaccgacgttcgtcagttagacttgaagtctttacgtgatcatgttggcattgtgttacaggaatcagtattatttagtggtactgtcgcagataatattaaatttggtgagccagatgctaccgaagaagaaatgattgatgctgccaagcaggcgaacatccatgactttattatgacacttccagaaggttatcagaccaaagtagatgacgaaaattcggtcttttcaacaggtcaaaaacaattattatcaatcgcccgcacaattttgactaatccggatttcttaatattagatgaagcaacatctaatgtagatacggtgacagaggcaaaaatccaagcggcgatggataatgttattgctggacgtacgagttttgttattgcgcaccgattgaaaacaatactgggtgctgataaaattgttgttcttaaagatggtcgagttattgaaaagggttcgcatcaagaattagttgctgaaggcggattctattcagaattgtaccataatcaaatggtatttgattaacatagtaaaaatcaacaaatagtttgaagtcctgtgttataaaggatggaaaatgatttgttgttttttttacgtgaagaacaattgcatcagtattcgaccatttttacgtaaaatgttataatagcagtattgcttttatagaaaatttgtatatttttgaacattggagaaaacaatgaacattggtttgtttacggacacgtactttccacaagtcagtggagttgcgacttcgattaagacacttaaagaagcacttgaaagtcaggggcacgaagtttatatttttacatctactgaccccaaggtacctaaaaataaatttgaatcgcatatttatcgtttttcaagcctcccatatcttggatttaaagatcgtcgactagcatttcgtggcttgattcaagctgttgaaattgccaaatctgtacaactcgacattgtacatacccaaacagaattctctttaggtttaatgggtaaatttgtggcgcgacagttaaaaattcctgctgtccacacctatcatacgatgtatgaagactacacccattattttgctaaggggatgttgattggaccgcatggtgtggggcgtattatgaagggatatatggctagtatggcaggtgttattgcgccgtcaaatctcgttcaagatacgcttcgtcgttacggtgtgaccgtgcctatgagagttattccgacaggtgtttgtttaccagagcatggtacgaaacaaactaacttacgagaaaagtatcacttttctgaattgcagcctattgttctgtcgctgggacgcttagcgtttgaaaagaatattagtgtgacaatttccgtattttctgaagtattacagacaatacccgaagcacgtttagtaattgctggtgatggtccagcacgtaaatctttagaagagcaggtcgaagaactagcgcttgcagacaaaataatattcacagggatggtcaatcatgatgacatctttgattattataagatgtcgaatgtgtttgtaagttcttcagatactgaaactcaaggattaacatttattgaggcgatggcagcagatagaccatttgtggctatacattcaccttacttagataatttagttgataatgaagctattggtacgttggtgagcgattatgatgaactactagcaggtatcacaaaatatcttaaacgaccaaatacagaagaagatattgcctatcggcataaaaaaatgaaagacgtggatgcaaacacctttgcaacacgtgttttagcattttatgatgatattttggccagttatcatgctagcgacgtggaagatgagtatcccaatgatgaagaggtgggatatatgaaacgtatcttacgtaatccattcaggagaaattaattgaaagttttactttattttgaaaatcaaaatttaatagctaagtctggtattggacgtgcgttaaagttacaaaaagaagccttatcttacacagatgttgaagtcactactgataccaagtcccttgattacgatgtactgcatattaatacatacggtgtgaatagccatcatatggtcaataaggcacataaattgggtaaaaaagttgtttaccacggtcattcaacttatgaagattttcggaattcctttactggttctaataccattgccccgttatttaaacgatacttagtatcgctttatagtaagtctgatgcgattattacgccaacaccttattcgaagcagttactacgtggataccgtttaaatcaaccgattattcctatttctaatggtattcccctagaaaaatatcagcatgatgatgataaaataaaaaagtttcgtgaatactttgacttggcagatgatcaaaaagtgattatgagcgtggggcttttctttgagcgaaaaggtattttagacttcgttgaactagcaaaaaggcatcctgagcatgtttttatttggtttggctacactgatttacgattagtacctaataagataagtcgtttgataaaaggtaatcatccacgaaatttaatttttcctggatatattactggggatgtcattcgtggtgcttttcaaggtgcagatttgtttttgtatccttcttacgaagaaacggaaggcattgtggtactagaagctttagcttccaagcaaaaggttttggttcgtgacattccagtatataaaaaatggttacaggatggggtaaatagctataaagcccgtgatttagatgagtttgaaatcaaaatgcaaaaaattttaactggggaatcaccaaatttaagtgaatcaggctataaattagctcaaacacgtgacctacctgaaattggaaaacaattacaggcggtatataaaatggtgttagaagggtgagtaatcgcgatgttcaaacgtgatagagtatcaatgattatcgttgttgttctgacggctattgtcgtttattttttgacaaaagaattaagtggtaaaggacaccaactgtccgtggcgttggaaaatctggattggcattggttactttttggcctgttcacgatgattatatcaattttccttgaggcggctgctacaagggccttattgagcaaagaagatcggcgccatacctcggttttgtccttattaagagttccgctactaaacttattgggaacaggagtcacgccatttgctactggaggccagccggcacaactatatggtttatcgcgatctggagtagaaactgggcgggcgatgtctgttattctcatgaagtttttagtctatcaaattgttgttgtggtattctttataataggctatgtctctgccgaacactttatttatcaacaggttaatcccactttcgcaacattcatcccctttgccatagcgattcatgctgtagtaattattggtattatattggttatgttttggccatcgttaacattacgcttggtcgatttagtggcaatagttgtaaaaaaaatgatgcgtcgcgagcgttttgagcgattaattgcgaatgttaagcaaaagattgataattttcataccgaatcacgtcgcgtaattagcagttggcaatcattggttggcgccactttttttacttcattacaactgattacgttctatatgataccttattttgtcatacgtgctttcggctatcagtctgtcaatccgtggctgattgtaacgatgaatattatgattgttatggtgatttccttgttcccaatcccaggtggtgttggtggtgcagagcttagctttcaattattgttctcaccttttgttaaaaatccagcaacattgattctcgttatcttactttggcgatttattacttattattttggtatctttgcagggataattgcttaccttattcctgctcaccatgataggaggagtgacaatgcttgacaacaaatacaatacgagtgatttgaaacaaattttaagtcggttacgtgctatgattgattcaacagatggcagcgtgcaaacgcgtcgatttgatgcttttggcattgaagctttacaggttacgtatgatcaattgacaaggatctggacagttcaggaacatcgtgaaattcgacagtttcagtttgatgatattgatttagttgcaattgaaatttatgatgttttacatgatttcaaactaatttattaggagggtgcccaacacatgctattaggatgttatcgggcacgtttataacaaatgataagtttattaaaacgaatctcaaatcccagaaacctctggcaccaagttaaacgaactatggatacatcggcgccaatagtttggtttttcatattaaacgtcgttcttgtgtggttgaagacgtatgctgaataccacatgaattttaatttaggtgtggaaggatcaacgcagcaatttttgctatttttgaatcccatcccgacggctattatatttttaagtatttccttgtattttcgtggcgtaaccagttattggttggcaattatttttaatttgattcagtcaatatggttatttgcgaatatgctatactacagagaattttcagatttcttatccatgggtattttgggttcgggtagttcaactggaacaaatcttggtaaatcaattgcggcaattattcattggacggattatcttgtctttattgatattgtgatcttaatcttgctagtggttttcaagcaattaacgattgatcataaaggcgttcaaaaaaagtttgctattttaacgacgctttttggtgtcatcttgatgttagtagattacggcatcgcatcaacggatcgttcaggtttgttgacccgttcgtttgataataattacattgttaaatatttaggattgaatgaatatgctgtatttaacgctgtacaaacttataatcaaactgaaagccggaagcgagcaaagccatccgatttagctaaagtaaaaaagtttgttgctacgcaaaaactgcctgccaatattcagtattatggtacgcaaaaaggtaagaacgtctttatgattcatttggaatcatttcagcagttcttaatagattataaagttgatgggcaggaagtcacacccaacctgaaccagttctatcatgaccaaaacacactaagtttcgataacttctataaccaagttggtcaagggaagacatctgatgcggagatgatgcaagaaaactcactatatggtttggctacaggttctgctatggtcaagtatggtacgagtaatacgtttgagtcattaccagctatcttaggacaaagaggctatacaactgctgcctttcacggggatgttgcaagtttttggaatcgtgataatacctataaatcatttggctataattactttttctctaaagcttattatgctaatgcaaacaaagcaaactataacattggttatgggatgaaagataaaatttttctgcgagatagtgcgaagtatattgaacagctcccacaaccattttatgcgaagttaataaccgtaacaaatcattatccatatgatttggataaacaaaatatcagtttcccagcaacaaaaactggagacaaaactgttgatggttatgttcaaactgctcactatttggatcaggcattcgctgagctgatgagttatctcaaaaaagctgggttgtatgacaattctgtatttgtgctgtatggtgatcactatggaatttctgaaaatcatcaggatgctattgcacagctacttggtaaagataaaattactaacaatgatttagctactttccaaaaagtaccattcatgattcatgcgacagggctaaaaggtggtattgaccatacatatggtggtgaaattgatatgttgccaactttaatggatgtgcttggcatcccagataataatatgacaatgtttggacaagatatgctatcctcgaagtacgatggtaaagtagttttccgtgatggtgattggataacgccaacgtatacgaaatacaataaccagtattttaatactaaaactggtgatcaagttacgctcaaatcagataaaaagttgcaaaaagtggcaaaacaaatgtccgcttatgcaaccaaagttttgggttactccgatgcagttattacaggcgacttattgcgctttgatacttcaaattctgattttaatcttattaacaaaaagaattataattataaaaaaacagagggactggcttcgcttaaaaaagcactcaagtctaatccttcgagtgtattagccaagaacaaaggcaaatcaacacttagcgactatgtcacagatgcaccggaattaaaaacagattctgatgacgatgacaagtagtcacaaaaaacgaacaaaacgctcatgtagaacgtttgttcgttttttgttataatgggatgatagtgtattaattgtgaaataatactgagcagatttatgaaaagagaacgtcaatgatagagcgacagatagagcatgaatttgaaattaagtctaaatatgaaccaaccggtgaccagccacaagccattgaaaaactagttggtggaatcaacaatcatgttaaagaacagatattactcggagctacgggaacaggtaaaacatttaccatttcaaatgtcattaaggaagtaaaaaagccaacgttggttttaagtcacaataagactttagctgggcagttatatggtgagctaaaagaattttttcctaataatgcagtagaatattttgtctcttactatgattattatcagcctgaagcttatgtcccaagttctgatacgtttattgaaaaagattcagctgtgaatgatgaaatcgataaactacgaaactccgcgactagttcgttacttgaacgtaatgatgtcattgtagttgcttccgtcagttctatttttggtttaggagatccgcaccaatataaggatcatgttatcagtttgcgtgttggatatgaatatgagcgtgatcaattaatgcgtgatttgattgatgtgcagtttactcgtaatgacattgattttcatcgtggaacgtttcgtgttcgtggtgacgtgatcgaaatttttcctgcctcccaagatgaaatggctttgcgaattgaattttttggtgatgaaattgatcgtatccgagaaattaattctttgacaggagaaacaatagcagaacgtgaccatgtagctatttttccagcaaaacattttatgaccgatgacgaccaaatgcaagtggcattggacggtatccgtcaagaaatgaacactcaggttgagctattcaaaaaagaaggtaagttattagaggcgcagcgtattaaacaacgtacagagtatgatttggcgatgctcgaagaaatgggatttgttggcggcattgaaaactactcacgttggatggatggtcgtcaagcgggtgaaccaccatttacattgattgacttttttccagatgattttttgattgttattgatgaaagtcatgttaccatgccacaaattcgcggtatgtttaatggggataaagctagaaaagaaacgttggttaactatggctttcgtttgccaagcgcattagacaatcggccattaaaacttcctgaattcgaaaaacacgttaaccagattatttatatgtcagcgacacctggtgattatgaaaatgagcgtgtcgattcaaaacacgttattcaacaaattattcgaccaacggggttgcttgatccagaagttgaagtgcgacctgttatgggacaaattgatgacttggtcggggaaataacgaagcgatcggagcgtgatgaacgtgtgtttatcacaacgttaaccaaacgtatggctgaggacctaactgattatttgaaggatttgggaataaaagtagcttatttgcacgcggatatcaaaacacttgaacgtacggaaattatccgtgatttacgcttgggtaaatatgatgttttaattggtattaacttattgcgtgaggggattgatgttcctgaagtatccttagtagctatattggatgctgataaagaaggatttttgcgtaatccacgttcattaatccaaactattggccgtgccgcacgtaatgaaaatggacacgttatcatgtatgcggataagatgactagatccatgcttgaagctattgatgaaacagcccgcaggcgagaaattcagatgcaatataatacgcaacatggtattacaccgaaaacaattaagaaagatattcgtgacctgatatctgtcacacatgctgctactgaagaaaaagttgttgatttgacaaaggtggcgtttaacgacttacctaaagatgagcaacagtctattgtggataatatgacgagtcaaatgaaggcggctgctaaggcacttgactttgaagaggcagctcaattacgcgatacggtaatggaattaaaaacacgtgctaatctttaattgaactgatataaacgaaaaagagaaaataatggcaaaagatcatatcgaaatacgcggtgctcgcgctcataatttaaaaaatattgatgtaaatattcctaaaaatcaactcacagtcgttactggtctatctggatcaggtaaatcatcattagcttttgataccctatacgcagaggggcaaaggcgctacgtggaaagtttaagttcttatgcacgccaatttttaggtcaaatggacaaaccagatgtcgattctattgatggtttatcacctgctatttctatcgaccaaaaaacaacatctaataatccacgctcaaccgttggtacagtgactgaaatcaatgattacttccgtttactatacgcacgtgttgggcgaccggatgatccaaaagatggtacaaaaattatgtatacaatcgatcaaatggttgaatatacattgaataacttgcctgagggtacaagattacaagtatttgcaccaatcattagaggaaaacgcggatcgcatgaaacagcatttgaccatatgcgcaaacagggatatattcgagctcgtgtagatggagatattattgagattgattcacagcagttgagtcttaataaaaacaagcctcacgacattgacgttatgatcgatcgaattgttttacgtggcaattctcggtcacgtctatttgactcgattgaagcagctgttcgtttgaatgacggccaagttgaacttgatgtggtaactcgtgatgatgaaaatccagttgcaccattaaagttttctgaccactatcttggagagttgaaggattttcgtgcagggcgattagaaccgcgcttgttcagtttcaatgcaccattaggagcttgtgagttttgccaaggtttgggtgttacgcgcgaagtggatattgatttagtaattccggacgatacgaaaaccttgaatgagggagctattctgccatggaacccaatatcatccaattattatccggaaatgttgcgtcaatttgctgagcaatttgctattgacatggacacaccatttaataaacttcctaaaaaacaacaagatttaattctgaatggttctgatgaaaaggattttcacttccattataaaaatgattttggcggggttcgtgatgttgatatcccctttgagggagtaataaataacattgctcgccgtttcacggaaacaaattcagatttcacgcgcgagcaaatgactcattatatgacagaattaaagtgtaaagcctgtggcggttatcgcctaaacaaggccgcactttcagtcaaaattaatggcaaacatattggtgaggtgtcggagttaccggttgatcaagaattggcattttttaatagtgtttccttgggacaacaggatagtgagattgcctcgcctattatcaaagaaattaaggatcgtcttggcttcctacaaagcgtaggtttaaagtatttaacactttctcgttcagcacgaacgctttctggcggagaatctcagcgaattcgtttggctactcagattggatctaatttatcaggagttctttatgttttagatgaaccttccattggtttgcaccagcgtgacaatgatatgttgctagagtcaatgcatcgtatgcgtgacttaggaaataccttagttgttgtcgagcacgatgaagatacaatgcgtgcggctgattatttgatagatgtcggccctggtgctggtgctttgggcggtactattgtggctagtggcacgcccgctgaagttgaagccaacaaaagctcattaactggacaatatttatctgggaaaaaatttattgcagtacctgccaagcgccgaaaagggaatggcaactggattacggtgaaaggcgccaaagaaaataacctaaaaaacattactgcaaagatacctctaggaaagtttgttgcggtaacaggtgtttcaggttctggtaaatcaacattagtcaatacagtgttgaagcgagctttgaagcaaaaactaaataataactctgaaaaaccaggtgcgtatcgatcaattgagggcactgaaaatatagaacaaatagttgatattgatcaatcaccaattggacgtacaccacgttctaatcctgcgacctatacaggtgtattcgatgatattcgtgatttgttttcacaaacaaatgaagctaaaatgcgtggatacaacaaaggacgcttttcatttaacacaaaaggtggtcgttgtgagaattgtcgtggcgatggtgtgatcaaaatagaaatgaatttcttgcctgatgtgtatgtagcctgtgaagtttgtggtggtactcgttataattcagaaacgttggaagttacctataaaggcaaaaatatatcacaagtcttagacatgactgcttcagaggcacttgaatttttcacgcctattccaaaaattgctaaaaagctacaaacgattaatgatgtgggcttgggttatgtaaaactagggcaatctgcaacgactttgtcaggtggtgaagcccaacgcatgaaattagcatcggaacttcatcgacgcactaatggtaaaacaatttatattctggatgaaccaactactggtttacatactgacgacattgctcgcttgctagaagtgctggaacggctagtagatgttggcaatactattgtagttattgagcataacttggatgtgattaagtcagctgattggataattgacatgggtccagaaggcggcgctggtggtggaaaagttttggtcgccggcacacctgaaaaggtgatgaaaacggcaggatcttataccggtaagtacttgaaagaagtaattgagcgcgatttgtcacgagcttaaacaagaaatctctcaagtaacgactaaaaccacctagcaatttgttgggtggttttgtgttaaaatgaatgtaagtatatggaaggttaactattatatgaaacccaaaatcgtcattattggtggtggttcgggtctacctgtaattatcaagccgcttgtgaaacaagaagttgatttatcagcaattgtgacagtggctgacgatggtggatcaagtggactactacgaaactacattaatatagtacctcccggagatattagaaatatcctcgtagcaatggcagatacggacgcggaatttttaaaggttatgcagtatcgttttgatgcaaaagatgatttttttgccaagcacgctgttggaaatctaattatcgctgcgatgactgaaatgcatggaaatatttttgatgcggtgcaatatctagctaattttatgcatgttcaagggcatatttatcctgtttctaacgagcctctagtgctacatgctgaatttaagaatggcaacacagttgctggagaagctgaaataacacatgcacatcaaacaatagaccatgtttgggtaacaggtgatgaaccaggtgaagagcctaaagctgctccagaggttgttgaagcgattttgagtgcggacttgattgtctatggtcccggaagtctgtttacatcaattttacctaatgtagttgtgcctgaagtccgtgaggcattacagctcactaaagccaagcaagtttacattgccaacattatgactcaaaagggcgaaactgatgcttatacagatgcacaacatctccttgctttaaatgcacatattggcatgcaagcaattgactatgtcatttcaaatagtgaaaaggttcctgatgattttgtcgactttcaaaagtggaatgaggtttctaatcaggtgaagcttgacgagcaggcagttgtggttcaaggagcaactcaaatttcaggtgattttttgcagttacgtgacgctggtgcatttcatgatggtcaaaaaattactgaagaattattgaaaattttggagcagtgctaaatgtcatatgcagcagatgtaaaaaaagagctgactggtttgattgttcatgccggaaatgcaaaagctgagttggcagctttaatgagaatgaacggggttagtacccttggttttgatcaaacaattcgggtgcaaactgaaaacgctgctattgcccgtcgaatttatacactcttaaaagaaacttacgttgaagttgaagttgaagtcagcgtaacagatcacaatcatttatcacaacacaaatcctatggggtattactaaaaactaagattgatgaggtactggatgatttaggtattgatccatttggcttacatccagaagtacctccgcgtatgctaaatcaagttgacaaacggcgttcttttttacgcggtgcttttttggctgctggatcagttaattcaccagaacgagctaactatcatttggaaatttatacgacccacgaagaactagctgagcaattgatgataatgatgcaagaatttgatttgccatcaaaaatttctgagcgaggtaatggttttattgtctatttgaaacgcgcagaaaaaatcgtggactttttgcaaacaattggtgcgactcaatctatgctcaagtttgaggatattcgtatgatgcgtgatatgcgtaattcagttaatcgcctggtcaatgctgaaacagcaaacatgcaaaaaacagcaatcgcagctaataaacaagttagtcagattaatttaattattgatacattgggtagtctagacatattaccaaaaaaactgcgtgacatcgcgaaggcaagattagaatatcctgatgaaacgttggcagaattaggtgaagtactagatattagtaaatcaggtgctaaccatcgcatgcgtaaattaacacaactggcaacaatgattgagcaaggtatagactatgatttaacaaagttgtaaaactttttagcactctcgtctctaatgtgctaaaatatatataagttaattattaaattaaccactctaagatatgaggtaaaatatatgtggccaggagttattgaacaaactgccaatggacgtgaaaattatgatttaccatcacgtttgttaaaagatcgtattattttggtacagggcgaaattgaagatagtatggcaacatcaatcgttgcgcaattgctattcttagaagctcaagatccaacaaaagaaatttctatgtatatcaattcacccggaggatcggtgacagctggattatcaatcactgatacaatgaatttcattaaggcaccagtaacaactattgtaatgggcctagcggcatcaatgggaacaatcattgctgcatccggtgaaaaagggcatcgttttatgttgccaaatgctgaatacctcatccaccaaccaatgggcggtgctgccggtggaacacagcaaactgacatggcaatcattgcagaacagttgacgaagacacgtgccaagttgaacaaaattttagctgatgcttcaggtaaggatttgaagacaattggtcgcgacactgaacgtgataattggatgagtgctgaggaaacattggaatatggtttcattgatggtattttaactaaatcaggtgaaaaaccagcaacaaagtaatacgcaatacatgaaaaaaacaccatatcaaggttttattaccttggtgcggtgtttttgtatactacttattatctaaaacgatttaaattttcgacgcttgaaacatgataacctttcttttctaagcgtttgataagtttttccaattgctcgctatcttcttgcaagggaagcgtgaagagaactgttaagggtttaagctcagattgaatggtaagtagtgattcaatatttgaatagcgtgtgatgattttagaaattttgctcaaatccccttgagtgttatgtgttgaaatagctatggcaacacctccagaacggactgaccaactttgtgacaataagtccattaaagcatcgtgcgtaaaaataccataaaactgatgattttcatctaagacagcaataaatggtaaatctctaatcgcaaaaaaaacttcataaaatttactattcgtgtaaataaattttgttgagttgcgcataatggctgttgcaggtaagttcatattcccgttttttgcaacgtgttcaaaaacgtgttgtttatagacattaccacgaaaaagcttgcctgattcgtcaagaataggcatggtgcgtgtgtgtgcgttttctgggtcattaaaaatatcgtatacttcttgaattgttgcattttcggttacggttgttaactccgatttagggattaccaaagatttttgaaacattatcctgtcctaatctaatttttttatcattaaatagccatacaatatgataacacaaaattgtagtgtgtgcgtggtatactggaggttagattattttagaatgctttatgaggaatagaaacgtgaaatttatatttggacttggaaatattggtgcagaatacgaccaaacacgccacaacattggctttatggctgttgatgcttttgcgacagcaaatcatatgtcattttctccaagtaagcaatttgctttggttgctaagacaatcataggcggagaatcagtcatgttggttaagccaacaacatacatgaacgattctggtaaagccgttcgagccattctggactattacgacggagatgttgatgatgtattagtattggttgatgatatggatctaccatttggtaaaatgcgttttcgtgcgaaaggatcggcgggtggtcataatggcttaaaaagcatcatgacgcatactggttcccagacatttctgcgtttgaaatttggactagggcatcctgttcatgagcaaaatgtagttgttaattatgttttaggaaaatttactgcagcagaaaaaccagacatagacgcaatgttggaccgtagtacgcaagcgatagcggattggattcaaggtgccacagcacctgaactaagtaatcgatataatggataaatgacattaatagactttttaagtgacacagtaacaattaaaaaacttaacgaacaggcaactgtgggctcagcacagttgcttttaggcgtgaatggcaccgctcgtgcggctagtattgctgccttataccgtaaaaatccccgaccaatgttgattatatctgacacgcaagtgcatgctgatcaatttttcgatgatctgtcatctttgcttgaagatttggtctacaactttccagcagaagagtctattgccacagaaatggcaattagttcttctgaattacgactacaacgcgtacaaacattacttgccttaaaaacagaaaaacctattattgtggttacaagtttggcaggtgcagaacgtttggtacctaaaaagcagtcactggaacaagcacatttacatgttaaagttggggatgcttacaatttgaatgtcattaaaaacactttaatgatgatgggatatacgccaactaaattagttcaaacaccaggtgaattcgcacatcgaggatcaattgttgatgtttatccaattacctttgatgatcctattcgacttgacttttttgatgatgaattggaccaattaaagagctttgatgttgcgacccaaaaaagtaccactagttttgacgaaatcaatattgaaccggcgacagattttatcgtatcagagcatcagtatgaccaggctaagttagcgattgaaagcgcttttagcgattaccgcaccaatctaagcggggttgataaaaagcatgccacggatggctttgctcccacacagtatatgttgaacgaacgagaacgaggtagtgtgttagtgccatatgctccttttttctttgatggccagacaaccctacttgactattttccaactgattcgttaatcatcattgatgaatacacacgattaatggaaacgcgacttcagcaaatgacacgtgatcaggaatggattgagcagcaaattgaagcgtatcagttattaccaaaacaaacttggcgaactgaaatcaccgatttattagcaagtaatcaacatgcgacaatctacttagctaattttcagcgtggactcaaccgaattaagtttaccaatgttgaagaagtgacaacgcgcccagcaaatcagtattatggacaaattcctgccttgaaaaatgatttaatatatgcacaggaatctggtattacaatggtgttattaattcctgacgctaaacgacgggctaacttttctcgtagtttatctgaattagaagtaccggtcactgagacgcgagatatagtgaaaaaccaagtacaaattatgccaggtgagctatcagctggatttgaatggccaaaattacatttgaccgtactaactacacatgaactatttacacaagcaaagcattccgcaccgcgaacccgcaaaattgctaactcagagcgtttgaaatcttataatgaattgaatgtgggcgattacgttgttcatattaatcatggtattggtcgctatgaaggcttgcaaacaattgaagctgacggtggaaaacaggattatctaacaattgcttatcagcaaaatgcgaaaatatttattcctgtcacacaacttaatcttattcaaaaatatgttggtgcatctgatgttgctaagaaacctaagttaaacaaattgggtggtagtgagtgggctaaaacaaaaagacaagttgcggcaaaaattgaagatattgctgatgatttattagagttatacgctaaacgcgaagcgcagcaagggtacgtttttccaccggatgatcatgcccaaatcaagtttgatgattcttttggttacccagaaacacctgatcaaattcgcagtattgaagaaattaaagttgatatgcaaaagctgcgaccaatggaccggttacttgtgggagacgttggctttggaaaaactgaggttgccttgcgtgctgtttttaaagctgctcattctggtaaacaagtcgcctttctagcaccaactacaattttggttcaacaacattatgaaacaatgttggctagatttagtgattttccagaaattaaaattggcgtattaagtcgttttcaaacgccaacccagaacaaaatgattattgagcagcttcaaaatcacgaaatcgatgtagttgtcggtacgcaccgtttgttgagcaaagatgtggacttttcagatcttggtttactaatcatagatgaagagcagcggtttggtgttaaacataaagaaagactaaaacagttacgaacaagtgttgatgtcctaacattgactgcaacaccaattccacgtacgcttaatatggctatggtgggcgcccgtgatttatctgtcattgaaacaccgcctgcaaaccgatatccaattcaaacttatgttttggcaatggattggaaaatagttcgtgatgcgattgaaaaagaaattgcacgtaacggtcaagttttttatctacacaatcgtgttgctgacctagaccgtattgttagtcaaatagaagaattaattccttcggcgcgtgtagctgcaattcatgggcagatgtcagaaacacagcttgaaagtatcctatatgactttttgaatggacaatatgatgttctagtaacaaccacaattattgaaacaggtgtcgacatccctaatgcaaatactttaattgtcgaaaatgctgatcatatggggttggcacagctttatcaattgcgtggtcgtgttgggcgttcgacacgcttagcatatgcatattttacttatccatttacgcgtacaccctcagaagaagccgagaaaagacttgaggccatacgcgatttcacggaactcggttcaggtttcagaatagctatgcgtgatttaagtattcgtggtgcaggtgatttgctcggtaaacaacaacacggatttattgattcagtgggttatgacatgtatactcaaatgttgaaagatactgtggcacaaaaacagggaaaacaagttacgacaagccaaccagaaacggatgcagaattaatcttaggtgtgctagcttatttgccagatgagtacgttagtgataatgcacaaaaaattgaattatattctcgcattcgtcaggctagaactgatgcagaatttgaagacattgagtctgatatgcttgaccgctttggtgaaatgccagatgaggtggcccgattattgctcgtaggtcaaattaagcagttagctgatcagtcacaaattacgaatatacgacgccaaagaaaacaattaattatgacatttaatgaaacagctacgaaaaacttagctggagaagccatatttgagacaatggttgacgtgccgttaaaagcagctgtacgaacagaagaaggtaatttacaagtgatcttcactgtgaacgatgtcgcagaaagtagtatctggctcaatattttacggaactttttgttagtcattattaataaattatcagcaaaaacattaaatgaacttcatcattaaatataggagaagaatatgcgtttagataaatatcttaaaatttcgcggttaattaagcgtcggacggtcgccaaagagattgctgaccaaggacgaatctcaattaacggtaaagttgctaagtcatcatcagatgtgtccacaaatgatgaattagaagtacgttttggaaacaaaacgctgacagttaaagtactcaaaattgttgaaacaaccaaaaaagaagaatctgctgacatgtatgaagttattagtgagaaatttcagcaagattttcgtaaaattggtgacgaataatagccaaaatgtttaagttagtttaaatattattgtaaaatgataaagaacgtgacaaaattacattaggtagaattcactatggcgggtaattttaaaagaagacaatcaaatattacaccgttaaacccagcgatagcacgtgaaattaaaaaatcagaacgtgctaactcggaagcggcaaaacattatcgcaaggcgcacgcgcgacgggagaaaaaaattcttctttttggcgggttgatagcgataatttttgttgtgcaactcttgataggccaagtgaagttgcatgcggctaatcaagaactaacgaatacacaagatcgtttggaaaaagtccaaaaaaccaatactgatttaactgctgatacaaaacgtttaaaagacgcaacgtacttacagcaactactacgagacaaatatggttattcaaagcaaggagaacttgtttataatttaccatccgataataattaaggaagcgccctaggggtgcctttttcgtatatgacagaaaaaattttgcaaactatacaacagtataattggccagagacagttatcgttgcagtttctggtggtgttgactccgtagttctagttcatgcgttgtcaaaaactaaggccaaccttgttattgcgcacgtgaattacaggttacgtgaggaaagtgatgatgatgctgacttcgttcggcagcttgcgactcaaactggtgccatatttgaagaacaggtttggcaacatattcctgaccatgcagtggaaaaagcagctcgtcaatttcgttatgatttttttgaggagttagctcaaaagtatcacacgaatacaatcgctgttgcccatcacgcagacgatcaagcagaaacagtccttcttaagatgatacgaggagggcaactacaacaaatgggtggcatgcaaacaaagaaccataaagttattaggccctttttgtcgataactaaacaagaactaattacttatgcacaggataatcagttggggtggcgtcaggataaaacgaactttgacgttgattatacgccgagaaatttattgcgtaacgatgttttaccaaaattaacaactattaatcaacgagccgtcagacatattaataatatggccgcacaaattttacaacaacagcggttaattgataatcaggctaaaatatacgctaatgatattcaagactggcagaagattcctacactttggcaactaccaacactgaaatattggctccaaaaaaataagctatttaacattaaagaaaatcaactgcagcaaatgattcaattgttgagcaatacccataaaccgaatggaaaaattgctctggcagataattttgagttcataaaaaattatcaaaaaattagtatacaaaaacaacaaaatatggcgcaagttttgacgccagttatgttaaaattgaatcaatggcattcttttgcaaaaacaacgttcatgtggactgataatgtccctatgaacggccaatcatttatcaagtttcagcttacgcgttcattaccatatctaagcttgcgcccagcaaaagcgagtgataaaattgctctcataaacggccataaaaatttacgacgtttagcaattgatgagaaactgacgccgcaagaacgtacaatgatgtgggttcttgcgacagccgatgatgaagtaattgcagtgcatttacgcagtaatcagtggcgtgtaaatgcggattttgctgttaaagaaaatacacagccatattggctcgtatgtcaaattgaggaaacctaagtggataacgatatacaagaagtgttgtatgaccaagaaagtattcaaaaagcggcagagcgtttaggaaaacaaattacccaagattatgcgggttcaacgcctttgtttttatcagtgctgaaaggcgcctacctttggacagctgatttactgcgcgaagtagatttatatgctgaactagaatttataaaaatctctagttatcatggcggtgtctcaagttctgatgaaataacgctcgtaacagacgttcgctcagatgttcgaggacgagatgttatcattttagaagacattgtcgatactggacaatcattactttttttgaaagaattacttgcgaaacgtggtgcaaaatcaattaaagtagcgactttacttgataagattgaaggtcgaaaagtcgaagttgatgctgactatgcaggattcaatgtccgtaatgaattcgtagttggttacggacttgactatgaagagcactaccgcaatttaccttatgtcggtattttgaaaaaagaagtatacactaaataaacttcgaacaagaattgaggaaatacaatgaacaataataaaggtggcttcttacgaagcagtgtattctatattttcatatttcttgctgttgtaggaatggtttacggcttgtttggtaacgataagacaaccacgaaaacgattacatcaagtgaatttattaaagcactgaatgataaagaattgaagtcagttacagtacagcctggtaacagcatctataatgttactggaacgtataagaaggcacaaacagcaaccaaggataagggacttagtttattccaacctacacaaaaggtaactaagtttacgtcaactttgctacccaatgatgcgtcgctaaagtcagtgacagacgctgctacaaagactaaaacagaattagtgactaaacaagctgaaaattctggattttggttaaacttgttggtatccttagtacccgttttgttgattgttgcggtattttacctgatgatgaaccaagctggtggcggaaaaggtggtcaaggtggcatgatgagctttggtaaatccaaagccaaaccttcagatcccaaggataacaaagtacgttttgctgatgttgctggtgccgaagaagaaaaacaagaactggttgaagttgttgaatttctaaaagcgccaaagaagtttgtgaacttaggggcccgcataccaaagggtgtattgctagagggacctcccggaacaggtaaaacgcttttggccaaagctgttgctggtgaagctagcgtaccatttttctcaatgtcaggatcagatttcgtagaaatgttcgttggtgttggtgcatcccgcgttcgtgacttatttgaaaatgctaagaaatctgcgccagccattatcttcattgatgaaattgatgcagttggtcgtcgtcgaggaacaggcatgggcggtggtaatgatgagcgtgagcagactttgaaccaaattttgatagaaatggacggtttcgaaggttctgaaggtgttattattttagcatctactaaccgttctgatgtcttagatccagcgttgcttcgttcaggtcgtttcgatcgtaagattttagttggagcgccggatgttaaaggacgtgaagcaatcttaaacgtccatgcaaagaacaagccattggcagacaatgttgatttgaaagctattgctcagcaaactccagggtatgttggagcggatttggaaaacttgttaaatgaagcggcattacttgctgcccgtcgaaacaagtccaaagttgatgctgcagatattgatgaggctgaagatcgtattttccaaggtccagccaagacaaaccataacatgtctgaatcagagcgtcgtacaactgcctatcatgaagctggtcatgcgttagtaggattagttcgttcagaagcttcagtcgttcgaaaagttactattgttccgcgtggtcgcattggtggctatgccttaatgacgcctaagaatgatcgatataacttaaaatattcagaggctaaggagcaactggctggtttgatgggtggtcgtgcctcagaaatatttatgtttaacgaagctagttcaggcgcgtcaaatgatttccaacaagcaactggtttggctcgtcaaatggttacggctttcggaatgtctgataagttaggcatggttcaacttgaaggtaatgctagcgttggctatgctgatcaagctggtaaccgtgcatactctgaagaaacagcccgtttgattgacgaggaagtacgtcgtttggcacgtgaagcgtttgatgatgctattgctatattgcgcgacaataaagacaaattgacagcaattgctgaggctctacttgaagttgaaacattagatgaaaagcaaatcaaggatatttatctaacaggaacctttactcgtaaggatatccaagatgatacagagcttgcaaaagcaaagtcgtttgaagaagcaaaagctgctgctgatgctaaggattcacaagctgaacaacgctttgaaaaacaagatgaagaaaagtcatctgacgatcactcagagtccaaaaatgaggatactgattcaacagataagtcagaaacagatgacaataatacagaaaataagtaaaatagaagttgacggtgacgtcgactttttattttgtcatgtgtttagcaaatacaaaagtaataaactgttaaataaaaaaatattaaattaaacatagggaaaattatggcagatcaatttatcaaagcaattactaaaaacaagtattttcgtacgtttgccgtaaatgggaccaatctcgtccatcaggcagcgcaaatccacgaaacatcgcgtattgctgctgttgttcttggacgtagtttgttggccacgaccttggcagctcaggccgtcttgaaaggtgaagaaaccttatcaacaaaaattaatggacgcggaccaattggcaatgttgtagtagaatctgatgctaaaggaagtgtgcgtggctacgtaaccaaccctaaccttgagacacttataaatgaagcgggacagcttgatgtggctaaagctgttggaaaaaatggctttctacaggttacaaagtttgctccctattctgatccttacataggtcagagtcaattggttagcggagaaattggggacgattttacatattacttagcacaatcagagcaaacaccatcggttataggtgtttccgtttatatgaacagtgatgatacggttgctggagcaggtggctttcttgttcaggcgctacctgacgctactgatgaagcaattgatcaacttgaggtagctctaaaaaatatgaaaccactttctgaaatgattcaagaaagatatacgccattagaagtacttgaagagatttttgggaaaggtgaagttgagatccttcaaacagctggcatcggtttggccgcagagccatccaaagacgcttatgctaaaatgttgctcacacttccagcatctgaaattcaggcaatgatcaaagaagaccatggcgctgaaattgtgggaaagttctccggaaagcgttactttttcacagaggaacaattatccgaaattttgaagcagattgaaaaaaataacgagtgactttgagattattgtttttttttggtatgatatttagttagtaggcgtgtatttaaaaaacgcgcaatagggaaggattttatacaaatggctgaagaaaaagcccttaatgatcaaatgctagcgcgtcgacaaaagttggcaacaatcgttagtgatttacacttagacccattcggtaagcgatttgaacgtacagcaaacgcgcaagaactgcataatctatatgatgccagctctttagaagagttagagaatgcaaaacatgaagttgttattgcaggtcgtatggttgcaaagcgtggcgcaggtaaagttattttcgctgattttcgtgatgtttctggaaaaattcaggtttatgcaagacgtgatgatttagcagataattatccgattattaaaagagcagatttgggtgatttccttggaatcaagggaattatgatgaagactgaagctggtgaattaacagttttggctacagaattaacacatttatctaaggctcttcgtccaatgcctgataagttccatggtatttctgatgttgaaacacggtatcgtaagcgttacttggatttgattgccaatgaagattctttcaaaaagttccaagaacgctcacatatcatttctgctattcgtgcatatatggatagaaatgatttccttgaggttgaaacgccaattttgcaaactgaagccggtggggctgcagcccgtccatttatcacacatcataatgctttgaatattgatatgtacatgcgtatcgcaacagaattgtacttaaagcgtttggttgtgggtggcatggaacgtgtatatgaaattggccgtattttccgtaatgagggtatggatccaaagcacaatcctgagtttacaacaatggagtcatatgcagcttatatggactttacagatgttatggacgaaactgaaggtattttcaaagctgccgcttctgtcgtctcagatgacttgaaaattacttatcagggaactgaaattgatcttggcacaaagtttgcgcgcaaacatctagtcgacttgattaaagaacaaactggtattgatttttggcaggaaatgtccgttgaagcagcacaaaagttggccgatgataaccatgtaaagtacgaaaaatactggggtgtgggtcatattatcaatgcattcttcgaagaatttgtagaggatactttggtacagccaacatttgtttatggacatccagttgaagtgtcaccactcgctaagaaaaatactgatgatcctcgttttactgatcgttttgaattgtttattatgggtagcgagtatgcgaatgcctttactgagttaaacgatcctattgaccaacgtgcacgttttgaggctcaagcggctgaacgtgagaatggtaatgacgaagctgaaggtattgatgaagacttcatagaagctttggaatatggtatgccacctacaggtggacttggtgttggtattgatcgtttggtcatgttattgactgattctgacacaattcgtgacgttgtgttgttcccaacaatgcgtccagaataataaatcattgacaagtcgttacacaattagttataataatatagttgtgttagcgacatcattccgacttagctcagttggtagagcacctgactgttaatcaggttgtcgccggttcgagcccggcagtcggagttttatgagaagcaaatcatcttgatttgcttcttttttatgtgataaactgttgacagattttctcactcatggcataataatatagttgtgttagcaacgtcattccgacttagctcagttggtagagcacctgactgttaatcaggttgtcgccggttcgagcccggcagtcggagtttcgccgacgtagctcagttggtagagcacgggtatcgtaaacctggggtcggaggttcgaatcctctcgtcggcactattatgcatatcttgcaaagcaaatcatctgaggtttgcttatttttttacaatgaaaaggacgcaattgaaaaacatgattgtactattcaataaaccgtacaatgttttaactaagtttactgatgctgaagggcgacaaactttggctgactacattgatattccacgggtttatgccgctggtcgtttggacatggacagtgagggcctattattgctgactgatagcggtaaactgaatcatgaattgactgatcctgataataaagcctataaaacttatgttgttcaagtagaaggggtcccaacaaagtcacaactaaagcaacttgagcaaggtgtggcgttaaaagatgggttaactttaccagctaaagtcaaacgtattccttatccaaaatggttatgggaacgagagaagccaatccgtattcgtaaaaaccagccaacgagttttattcaattaaaaataaaagagggccgtaatcggcaagtacgccgtatgacagcagctgttggtattccaacgctacgcttgatacggacacatattggtgaatatcatattgccgacttaaaaccaggacaatatcgaattgtgaagtaatgattttgtggtgcaaaagcatcataaacggttataatagtaaaagatgtaaattaaaagaggtgacctcatgggacgtaaatgggaaaacattaaaatgaagaaggcgcagactgatggtgctgccgctaaagttaacagtaagtatggcattgaaatttatgctgcagcgaagcaaggtggcagttcagaccctgaggctaattcaacattaaagtttgttattgaacgtgctaagcaagcacaagtgccaaagcacgttattgaacgtgccattgaaaaggcaaagggttcaggggatgaaacctttatcgagggacgttacgagggatttggaccaaacggttcattgattattgtagatacgttgacatcaaacgttaatcgtacagctacaaatgtgcgcacagctttcaataaaaatggtggaacttacggtgctgctggctctgttagttatttattcgatgaaacaggcgtgattgtttttgagggtgaagatgccgatgctacgttggaaacactgctagacgctgaagttgatgttcgtgacgccgaacaacaagatgatcatattgttgtttatacagaaccaactgctttgcatcaagcaattgctgctctgcgtgaaagtggtgtgagcgatttctcaactacggaaatcagcatgttgccacaatcagaaatgacactggcaggcgaagacttagaaattttcgaaaagttaattgatgtattagaatctgacgatgatgttcaaaaagtttatcataacgttgaatcataataataaataaaaaacgcaatggcattcattgcgttttttatttgtgaattaattttgtgcaaaatgccgattcgcaagagaagcaatatatttggaaaaatcaatatgttcattaaaaggttggacaacatcaaagacttcgccacctgcctgtttgaaaatatcatgattttcaacgtgaatttcttcgatggtttccaagcagtcggctacaaatgctggagttgctactaggacacgtttgataccttggctgggcagtgaccttagtgtgtcacttaagtatggtttgacccactcagttggcccaaatcgtgattggaaaacctggtgagtattatcaggtgttaacggcccaacgcgctctaaaacgccttgtgtggttgctgtacagtggtcaacataagggtcaccacgacgaacatatgattcgggaacaccatgataactaatgattaaacgatcataatcgtttttagcccacgcctcgcgaatgtctctagctaataaatccaaataggcttcatcgttgtaaaatgacttaacaatgttaatgtttttgtcggccttacggacttgatcaatgactgattgtgttgatgtaacagaatattggggaaacagtggcaatacaacaatgtcttcagcgcccgccagacgcatttctttcagtgtttctgcaatgttaggcttacgataagtcattgcacaacgaacaatccagtttggttgtaattgctgtacttgctcaacttgttttttcgcatagaccattaatggcgaaccgtcttttcgccaaattttttggtaaagttcagctgatttaaacgatctcttaggcaaaattttacctcttaaaatgggttgccagagtagtctgggcatttgaataacgttggtatctgatagaaactcttttaaatatgctttcacatcatctggatgtggggagtcaggggtgcctaggttgactaataatagaccttttttattcatatggaagcgatccttatctagtttaatatttaatactataactcaatttttgactaaaatgtatgtcgaaaagcccaaaattgtgataaggataactattgtccttttatttagaaattatttttgcttacaaaaataattcgaatttgttaataaatactatatttttttctcggattgtttgctctgacattatagtatgtcgagactatgttttttaagccttaaatcatcagcacagtttattttgaaaattgaaataatttccataacaatagaattaggattgagtaatgtcagcatattcgtcgtggagaaaaaagcctgacaacgtctaaaataaaaggaattgttgattattaagaagagataataaaaagccgcaaccggagttgcgacttgatatagctcgtgagagaatcgaactctcgattccgccgtgaaagggcagcgtcttagccacttgaccaacgagccatggtcaataatgtcaatctgtatcagatgactataatataatatcaagtttttaagtagtcgtcaagttatttataagtattttttgacaagtaattattatcatttcagtttaagcacttgtcttctttgaatatcaatgctagactattctatgtgaaatttagctgatatagtatcgaataatggtcgattgtttctagccagcacccatgctggaactatcataaacatgttatttaattgatagccactcgtgcgtcaattttttattttccattgatgtattcatacaaataggctgatgagttacataattgtataggagagaataatggaaaaattatttcaattgaaagaaaataaaaccactgtccgtcgtgaaatcattgctgggattacgacatttgtatcaatggcctatattttctttttgaaccctcaaattctagggcaagctggtgtgccaacacaagccgtatttttagcggctattctagtagcagtttttggtacattgtttatgggcttgtttgctaatgtaccgtttgctttggcaccaggtatcggcatgcaagcatacttcacgtatactatcgtgtttggcttcggatttacctggcagcaagcattggctatcgtatttttagttggtgtagtggatattgtcattacgttgacacatggtcgccgtgcaattgttaagggtattccaactgaattaaaagcggctattggtggtggaattgggttgttcgttacttatatagggttgaaaaacgccggttttatcaattttattgttgatcctagcaatattatgacgctaaatggcaaaccgttcactggagaagtacatggtgcggtaaatagcatcttggccaatggtggtgtaacaccagaattgactaaattcaacaacgctagtaccttattagcattaattggttttgttattttggttgtgttggtgatgcgaaaggtgcctggcgcattccttatatcattgatagtgaccacattaatcggtattccaatgggtgttacgaatacgcatattggggctggaacctcagttagccatgccttcggtgaattggggcaggtgtttggtcaatcattaggtgctcaaggattgggcagcttatttaataactggcatcatgcgtcattagcgttagttacgatttttgctatgggcctaaccggattatttgacgctattggcacattaattggtatcggtaatcaaacgggcattttttcaaaggaagatcagaagtcatttgagtctagtaatggctttaactctaaaatggatcgtgcgctagttgttgatacatttacaacagcatttgctggtattgttggtacatcaaatacgacaaccttcattgaatcagcatcaggggttgcagccggagcaagaacaggcttggccaatgtcgtaacagctgcaggatttgccttaatgatcttatttgctcctttggttggtgttgtgccaacagcagctacatctccactacttattttggtgggtattatgatgatgggcgaatttaagaaaatttcatgggaatcattagaagttgcgttacctgctttctttacttctgtgtttatggcctttagttattcaatttcttatggtatcgctgctggtttcattttctttattatcgtgaaatttgctttaggaaagtttaaggaagtctcaccagtgttattaatcgtatctgcattcttcttgcttaactttgctgtacttgcatttatgtaatgtcagtgaattatattaacaggtattttcattacttgtattcaaccgcttatcacaaaagcggtttttttatgccctcaattgctacaataaagccaatattagaagggtgataatatatgttaaacataaaaaatttaagtgtgtcttacggaagaaaagttgccttaacggtgccaaaactatccatcaataagggtgagattataggagtaatgggtaaatctggctcagggaaatcgacgttagttaatagctgtctcgggttgattccttttaagggtcaggtgagaattgataccgacgatgttggcatcttaatgcaggaacagcactacgttgatacgatgacaaatcaaaaaatgatagaaggcatgctgaacacgcgtattaagcgagataaaaaattaactgagttaattaatttttttgattttagtgaccaactatcacttcattttaaaaatttatctggtgggcaaaaacaacgaatgagcttgattatggtactttatcaagaaccagaattactatttttggatgaaatgacgacgggacttgattttgaaagtcggcaagcactaattagtcaattgaaaatctattttaagcaacaccagacgactgttctgatggtcacgcactacgcacaagaaattgaagcgttagctgataaacttctagttattcatgatggccaagtaaaagcttttgatgaacccaaaaatttgtttaagcagtatataggttattctgcttttatagtagacaatcatactgaaaaaagcatcaaagtccaacaaccagaagatgaatacaaggtcgcatgtcgactgattgatgatggggatgactttaggcggacacaaagcgatattgaattagtttatacggaagttatgaaggggcagcgggcatgattaaaaaaaggaagttagtctttgaatttcaaaatttattaggtaatatcattacattattttttgggtttgcgtttgcaccaatgatggcattagtgtttggcaatagctatgctaacgtaccgcaagctttgaaccaactttacctgggctttttttgtacgataccgctttcgatggtatttgttggttttagttcattattttcacaagaagtcgagcaaggttttacattgcgtgccgaacttttcggttattcgcgcgtttcacaagccttacacaaatttatggcactaacagtgtttgttctattatcaagcatcatctactcgtggatttttctatcacattttaatttgcctctgccaaatgcagtaatcatcggtcaaatggcaatatttcaaatattaaatacagcagtatatttcatcattgtttttatcctgacaacgattttgaagaaattttcccgtgtctatggtatttccatgattagctattttgctatcatgattatttcaggaattatgggtaatatggatgtcggtaagttaggagattatttgccaatcaaattatttgtcaccaattataccaatcatcttaatgacactgattatatatctggtaaaataggtctatatctacttattttattaggtattctgggtgtgattttgaaagtgattgtgagaaataaaaatggaaataaacatcaatattgatgataaattgaaagatgttcaagttgttatttcaggtagtgatattgagcaattagcagatattgcgcagtatcttaaatctagaaacacaccttcacgacagcttgctatcaaaacagctgacaatattcgtgttgtagataaagaagatattattttagttgaaagttatggaaatgatttaacttttacactcaaaaataatcacaaaatcacaactagaaaaacgttaaaaaggtttttggaagaaaaccaaaaatctgatttcgtgcaaatttccaaatcagaagtaatgaacttatcttatttgtcgaagatggaatctgcgttttccggtaattattacgcttttttgaccaaccaggctcgagtaaccgtatctagacggtttatcaaaggtattctaaaaagattagaagggagcgcagaagatgaagcattttaaagaggcaattgtatatctattagttggcattggcgttggatcatttatctctctattatcgtttaccttaaatcatgcaacaccatcgatgaagcaatttggtctgttaatgaccatgagcgcaattatgggcttattatctctcatatttgagtatgacaagataacgtttattacacagctcattagccatttcattttggagatgttgacatatggatttttcatttggttaacgtttggaagtgcagtgattacgtttactaatataccaacatttgtgattacttatgtcattatttttatctacttcaggaaacaaggcagagataatgcgcgccgtattaatgagcaattgcaaaaaaataagccgaaaaaaagtgattcaacaaattaatgagatgttgaattgctttttatattggctatacattcatggtttaattttctagttgaccgtcttcgcggattaacttgtaatctgttaaaatagaataaatcaactttaagaaagattaaaaatattacttatgccaaactacctcattttaactgaaaagccttcagcggcagctaattttgtaaaagcgcttggtggaaaaacaggagtttttggtgattttacatataaaattacaaatttacgtggtcatgttatgaccttaaaagatcctgaagagatggtggctgaagatttaaaaaagcaatataaatcttggttggtgaaacatttaccatggaatttagaagatttttcttgggcacgtacttatattcgccaacgtaatattcgtacaggaaagattgaatcaaccaaaaaacttattgatgaattgaaaaaggagtccaaatcagggtacgatgcgattgtaatcgcaactgatacagatccttccggagaaggggaactactcgcttgggaagcattagacgcaattggctggcgtggacaggtattacgtgctaattttatggatgagtcagtgtccggcattcaaaaagccatgcaccaattacgaaatgtttccgataaaatggcggatggggagtatgtaaagggtgaaagtcgtaaccgctgggattttgcgtctatgcaacttacgcgaattgcaactaccgccgctaaaaaagaaggatttaaagtggtcgcgcgtgaaggtcggttgaaatctgttattgtttggcgtatttatcaacaacttgcagctattaaaaattatattaaaacgccatattttgaagtgaagtttaaagatccagcggggcatatttttggacgagtgacaccgcagggagaggtaattccttggcgttttgcaacaaaagaacaagcaaaagtcgattttaataattatcatgaaactgaagtcattaatgaaaaacaccaaacacgtacacaagcacccggtaagctgttagatttagcaggattggcttctatattggcacctcgtgggttttcttccaaagaagtattaagtacctatcaaaaaatgtatgaagcacagatcgtgtcttatccgcgtacagaggataagacagtgacgccggaacaatttaatgagttattgccgttgattgatcaaattgcaggcgtcgttggtgttgataagaatttactaacacaccgttcaccacgaaaaacacatgttaagtcacaaggggcacacggtgccaatcgtcctggtgagaatgtgccacaaactacgcaatctttagcaaaatttggctctagtggaccagcgatttatgaagttttggctaaaaactacttagcgatgttagcagaagattacgtttatgaccatgttacggctaatttgaaagattatccggaattcaagacagccttcaacatcccaattaagctaaactttaagttagtctatgactcacagaaagctattaaggttgaagaaggtgaagaagaggagtcaattagtggccaattaggtccgcaagcaaggccatatttacatgaaggtgcgaatccaaagccacaggtaccgacgaccaaatggattatggcgtttttagaaaagcataacgttggaactggtgcgacgcgcgtatcaacactatctgaaatgtctcgtggcaccaaagccatgttaactgaaaagcgtggtaaattaggtttgacggaaactggaaatgtatctgcaatcatggtaaaagatacttggattgcttcaccaaaaatcacaaagcgtttattcgaaatgatggaccaagtcggccgatttgaaatgacgatggttcaagtactggattcagcgacaaaagtagttgaacacgatatgccgattatgttagacaatgcgcagacacttgaaacattgcttggtaagcccaaaccaagtataaaaaagccacgtaaaacatctgaaaaaatgaccggtatctggcaaggacaggaaattacctttgctcgcgaatggagtgggcacgtttttacagatgaagaactgcaaaagctactgactggatcagaagtcagctttccagctaagtctaaacgtggcaaatcatacacggctgttggaaaaatggcgaaacaaacttttaaggggaatactttttatggttttaagttgaacccaaaaacaaaaaaagcatagtcaacatagggttgattatgcttttttgtttattaatgtgttttcttttgacgtttatctgacaacaaagcgataggagagcaaagtagtaataagaaagcacatatgacataggttttactgaatgcatggcttagggatgtatttttttcctttttaatttctgataaactacttttcaattcatccctttgagccagcaatttaatggcttctaacatgtttttttgaccatttagtaaagttaaggtaccatcagatagcgcaataatactgttgtttagcactttatttgttgtggttgtgcccgctaatttttgtaaagaatcattgattttttgatttccctcactaattttaaatgttgcatcatatagctttcggtagtctgtgccttttttaggtcggggcaggctacttttgtttaaagcagcatgctttaattgtttagtaaattgtttttgtcgcgacgtatagttgacatttttttgatcattgcttgaaaaaatctgcctgattccggattttgcagtatttttaatatttggagataaggtttttcgattgattatggctatggaatgattttgtatatgagacttggctgttgatatattagtattgaggacagtaattaatacagcgagtcccagacaagtaccaatttggcgggaagcattcgtgataccggagccaatgccagtttttgattttggtaagtgcctgacggaagaaacaaaagaaaccgtagagaaaccgaatccagaaccgataataatcgagaaaacaatcattattcttttgggtgttgttgtagttataaatgagaataatagtaggctaccagctataagtagcataccaatcaagtttacaggaatggcgctgattctatcagatagtcgtgtagcaaggggcattgtgacagcgatagctaacgaaacgggtataatcattaaagcagcatgcaaggcatcataattgagtacattttgtagataataattaaaaataacagctggggcgactagcgcaaatccagtcgcaaagtaaataatacaagatgaagtgaatgttttgtcacgaaaaagattcagttcgacaataggtgaactaacttttagttctatcagaataaacgcgattaacccgataatgccagctaaaaagcttgacaaaataagcgttgatgtccaaccgtactcacggccttcaagtaaaccaaaagtaattcctgttaatgatatggttaaaaaaagcatgccagaaatatcgaaatgaccaacaagtgtttcatcaaaagactcttttgtaaagagcagtactagtagtagagatattaggccaatcggtacattaaggccaaatatccagtgccaagacatatattacaaaataaagccaccagcagcagggccaccagctgccgcaagggcagtaatggcacctacaattgccgcaatttttgacatgtgttgtttaccaaagagttcaacacccatgggcaataccagtggtgtaattattgcgccacccaatccttgaaaagatctaaaaactaaaagatacatgagtgagggggcaaacatgcaagctgccgaagatcctgcgaaaagaagtaaaccaataatcatgagtttttttcgaccaaacttgtcgcctaattttgtcgctgtaatcataaaaacggctaaggcaagcgtgtaggtagtagcaacccaactaactcctgccaaattagtattgaatgtcgtcattagttttggtaaagcaatattgactatggtgctgtctaatgtccccataaacatggcgattgtcagaccaatgaatcccaaacgttttgttgatttaatcatcttaaaattctcctactatttttattcaccttgttttctcctttttgtgcatcgttataaaagtgtacaattgtagtgacgtttgacacagaagtgtattcatgtcacaattgtgccaacaacatatagtataggcttaaaaaaatgaaatagaagcgctgaaataaaattataactagttacacagattaaaagatttgtgtcaaatataggaggaacttgatgaataaccgaatgtcgttgcaaacaagagaatgggtgcggagtgcattcttggagttattggatgaagtagaagatattaaatcaattaccatttcagatattagtaaacgatcaggaatatcaaggagaacattttaccgctactatgcctctaaagaagatattttgacggaatacattgatatcctaattgagcagtatggtaatgacttacgctcaaaaaaattagcaaatttcaaagagtttatcgtttatttttttaattattggggtcagtatgatcacgagttgtttatattacaaaagaacggtttattcacctatgtgttaagtgagtttaacaaaatgatccctgagttgtacgcaactatttctgcgccttggcatattcaaaaagaggtgaatagtcgtgaaataatctatacaacaaggtacggggttggcggcttatggaacgtatacggggaatggcttgaatttgatcgtgaaaagattgaaataacggaagttgccaaaatactaatccaatcgtttaattccttataaaaaattaggaaagaatatacatcaacatacagttttataaaattcttgtgttattgtataattaagagaattacatgagaaattatttataaaatgaaagtgtgaaaatgaatgaactataatgcaccacatcgacatgctgtaattgagttgtcgcaatcagcagttgtgcataatttaaaagtgattaaagagaacgcgcatgccaaagagattatggctgttttgaaagctaatgctttttcgcatggattacctgagatggccgctttgagtattacagctggggctacccgctttggcatggccatgctcgatgaagctttgacattacgtgatttgggctatatacaaccagttgatgtactcggattaacagatccacgctatgcgcgattggctgctgaacgtaatattacgctagcttttagtactaaggagtcaataaaagcagcagctgaacagttagctggtacagggttgacattaaaggtatcgttacccgttgacacgggcttaaaccgtattggttttaaaagtcgtgaagatttagtggcagcaattcaagaggtatcagcgcaagatacactcatttttcaaagtatgtggacgcattttgctactgcagatacaccaaatgttgactatgtggattttcaaatttctgaatggcagcgcttgacacatgatttaccagtagaaccaaatgaaaagcattttgcgaatacgggtattgctacttggtatccagaaaaaattaatacggatattgttcgtttgggtattggattatttggcattaacggttctgtgccaataatgtcgatgccattcgagttgataccagctttatcattgaaagctaaggttgttaacagcaagccactgaaaaaaggtgatgcggttggctatggggcagaatatcatgcaccaaatgatgggtatttgattactattccaattggacattctgacggttatccgttcaatgggagtggcatgcgtgctctggttgcggatggacaaattggtcatattgtggggggcgtagccatggatcaatcaatgatctttgttactaatccagttgcagttggcactacggtgaccttaattggtcgtgttggtgatcaaagtataacgatgcaggatttggctgagcatacacaaagtagtattgtggcgttaatgaatgattttgcaccgagactgcaacgaataattgtttcataaaaagaaaaaggtgaacgacatcaagtcgttcaccttttaaaattattgcccctgctggattcgaaccagcgcgtagtggcaccagaagccaccgccttaccgcttggccaaggggcaattactttatatattttacagaatttgttatcaatttgcaagtggaaattaggagataaattcgttatactggttaaaatactttaagggggaatactatgcaatatgcaacatatgaaaatacagtcgcaaagttagctgcgcatcatattacgatttcagatatcgcgcgaatagcctttaacaatgagcaatcgtatgtcgaaggattaacaattgaacaagtagaagatgcagttgaaagtatcttacataagcgggttgttcagcaccaggtatgggttggtttagaacttgatcgtttggccgaagctcatttgctagaagcaccattgcaagatttggttgaaaatgatgatgggctttttggtgttgatgaaactatcggtacagcaattgcaatgtcctttgatacaattggtgtcacaaactatggttacattgataaaacaaaagttggccttgttggcgaattagatcgtaaaggaaaaacttctgaagcggtaacaacgtttgcagatgatattgttggcgcactggccgcagctgcagcatctaaagttgcgcacaagtatgcgaccggtagagttgattctgttctaccaaaccaagataacgcttaggcgttatttttttgtagttaaatttgcataataggtctagaccaattatactataattatagacttcattattatcgttgtagaggcaagattgaggaggaatgtgctgcgtggtgacttcacttcgcgtacgaaatattatggcaaaactaattaaaagcattgatctttacacagggtatcaacatatggaagatgccttcatgcgttttacagatacggttgaggaagtcggttacatgattgacttcaaggaaaaagctgatgacgaattgattaatgaggcctcagggaagataattgttccagggtttattgatgttcataaacatggcggttatggattagacacgatggatggtgatcccgaaaagttaaacaccatgattaataagatgattacggaaggcattacatcactattcccaacaacaattacacagtcgccagaaaatattgaacgtgctttaaaaaccattgatcaagtcgccaaaactaatccggttattcaggggattcatttggaaggaccttttattaacaaagtcttcatgggtgcacagcctgaagaatatattattgatccaaacacagaacttctgaaaaaatggtatgcactttctggcgaacgtattcgattagtgacctacgcgccagaaaatggcggtattcctgattttgaagaatttatgctacagcataacattattccatcaattggacattctaacgcgacacgagcacaattggtacactcgcgtgcaacacatattactcatttgtataatgcccaaaggccattacaacatcgtgaacctggtgttacaggacatgctatgctagaggacgcaattactggtgaattaatcgctgatggttttcatattgtacctgacatgttacaattagcatttagaatcaaaggcgctcacaaattagaactagtaacagattccatgcgagctgaagggttaggaaatggtatatctgaacttggcggacaaaaagttactgttaaagataagcaagcgcgcttagataatggtcacttagctggttctgtactggcttatgatgatgcgttcaccaacattcaaaaattcacaagtgctgatattaatgatgcagtgcaaatgagttcagttaaccaagcacgtgagtttggactaacccaaaaaggcaacttatccgaagggaaggatgctgactttaacatttttgacaaggaattgcatttagaggcgacgtattcacttggtcgccgttttgcacggtaaaacaatggctaaacctcgatatattgaaattcacaatcaaatattgtcacgtatcgaagctggtgagtggcgatcacaagaacgtttacctgctgaaagagatttggcacttgaatttaacgtgtcgcgtatgacattacgccaagcagttcaaacattggttgacgaaggcatattggagcgtaaagtaggatcaggcacttacgtcgctgaacagaaggtttctgaacgtgccctgggtgtcactagttttacagaattaatggcagctacaggtcgaacgccgcatacggtgacggttagctataagaccacgacgccatccgcttcggaaattgagcatttgcaactggatagtacagataaagtattgatcatggagcgtttacgtttgggggatgatgaacctattttactagaacgtacaaccttgccagtccaattaattgagtcattcactcgtggcgcattgacagaatcattgtacgccacattagcatcagcgggggtataccctggacatgctgaacaaacaattacggccacgttagcaaatgaaagattgtcggaattattacagataaaaagaggtgatccaattttatctgtgcgacaggtctcatatgatcaacatgatacgccgtttgaatatgtgcgatcatattatgtaggtgagcgtttcgaatttactttaacaagataaaaagatggttgatctatgatcaaccatctttttttatttatgattaaacttcttagccaggaagtcaccggtaacttgaacagttaacaccaatattaagacaagcagtgtagcgaccaaagttgtgtcagttgcaaaacgattgtatccgtatgaaatggccatattacctagaccaccagcaccaatggcaccagccatggcagttaaaccaatcagactaattaaagtcacagtcgatacacgaatgatttctgaaaggccttcccgtaaataaacgccaaagacaatatcccaaaatgatgaacccactgactgagcagcttcaacaattccgctgtcaacttcgctcaaggctacctgtatttgacgcgcatagaaagggaatacacccaatgataatggcactaaagcagctgtggtaccaatttgagtaccaatgaggagctttgtaaatggtgcgataaaggccagcaaaataataaatggaatagcacggaaaagggacacgaccttatcaaaaatccaaaatgaagctttgttcggtgcaataccgttgggtgcagtaatgattaatccaagaccaaaaattagcccaagtatgccaccaaaaatagctgaccaaaaagtcatatacagcgtttgaataattgatgtccaccaaccagtatcgccgctccaaccttgataaacaacgttagggaatgtatttgtaaaccattgactcataattagttgcctcctttaagaattgtaacttcaacatgatgatcatgtaatgtagatagggctgtttgcacttgcgtgggttcacctgacaaaataacaagcaaagatccaactggtgtatcctgcaagacttcgatattaccatacagaatgtttgccgtaacattgaaatcacggaacaaactagcgattaatggttcatcagttgtttcaccaacatatgataaacgagcaaaaatttcgccttcttttaactcattaactagtggttcgtgcctaattgtttcaatggctttatcaatatttgtagctgtttcaataaattctcgtgtcaactgttgctttggctgggcaaatatttccaaaagtgagccgcgttcaatgatttcaccattttgcatcacagccactttatttgcaacttccttgacggcctgcatttcgtgcgtaattaatacaattgttaaaccaaattcctggtttagcttttttaatagggccaaaatttgattcgttgttctaggatccaatgcggaagttgcttcatcagaaattaaaatttcaggatcattggctaacgcacgagcgatagcgacacgttgtttttgaccaccagaaagttgtgaagggtattgttctgcacgatcagatagatcaactaattcgagtagctcagccactttagctttcttttcatcgtcttttaatttactgtgttgcagtgcgaaggcaacattttctgtgactgttcgttcatttaataaattgaaatgttggaaaatcattccaatctttcgacggcgaacacgcaagtcatttgtgccaatgcgtgtttttttagcatcctgactatcagcctgaaaaaaagtttctccattaacagttacagaaccactagttggttcttgtagtaagttaattacacgtacaagtgttgactttccagcaccagaatagcctacgataccgtaaacatcaccacgttcaatattgatggaaacgtttttgacagcttctatggtgcgctttttttgatggaaagtgacatcgatattttttagttcaatgattggttctgtcatttttcataactcctaattagttctttgattacagcaatatgttgattataatctgttaatcggatattttcattgggtgcatggtctaatgtatgtgcgtatcctacacccaagctagctatgggtgcgttcaatgcttcgtgaatgtaatacattgggccagtaccgggtgacgttggcataataactggatgctgatgataatacttttcagtgatatcaataacacgcaaaatttcgggatccgacatgtcactgcgatatcctggttgacctaacgtcttagttaccacgatatcagaaaatccttcattttggaaatgctgtttaatttgttgcaaggttttgtcaggatccatattaggaactaaacgtgcttcaagtttagcagaggcaacagcaggcaaaacagtttttacaccgtcacctaaatagccactttgaataccttctatatttaatgttggttgaaaatataatgtttcttttaggtcatcgccagttttatcacttaaaagtggcgaggttagaccatgttgttgaatcaatgtgtctcttgttgtaggaagacttctaaccagttctttttctcgttgattagggatggctacatcgtcatagaatcctgggacagcaatgtgaccttctctatcaaatagggttgctaaagcttgggtcagacgccaagcagcagaatctacgacaccagctaaagatgaatgaagatcggtctttgctgtttttacatcaacattgaatgttacgatacccttgttaccaccaaaaatctccaccacatcatgcacgttttttccgcctgattcccaaataactaaatctgcgaatagttgatcttgatacttacttaagtattcatccaagtgctgagaggatgattcttcagaaccttcaataataaaagtgatatttactggtaaatgaccttcgtgttcagttaagtaatcttcgatagctgtcaagcgggcagtgatgtttcctttgtcatcatcagttccgcgtccgtataatttaccgtcatgttcagaaagcgcccaaggatctgtttgccacaatgatattggttctaccggttgtacatcatagtgattatagataactagcgtctgagcatcagggacgctgctcctaaattgcgctaatacgaatggcgcaaaataagtatcatcataggttacttgagcacctaattcacgaaaagttgtcgccaagagttgagctgcttcgggtaaacagcgatgagttgccgaaacactgggtagtgcaactaaatcgcggagtaagtttagatatttttgattagagctcatgttcatttattaccttccacagaaattatgtacgcgccgaggcgcatgtctttacttgttatagtcccaaactgtaacttccgctgaaccgtaatattttttaactagtttctttgtcttatcagtttgcaatgacttcacgacctttttgtaagtctcgttgtctttgtctttcttattggcagcgatgaagttgaagtattgttcagtttccttattcaaaccttccacgtaaatggctgaattgacatctaagttagctgatacggcgtaattggtgttcaccacggcaccagcaacttttgaatcatctaacgatttagcggtttgcgaagcatcaaccggcgtaatcgtcaagtttttaggatttgatgtaatatcttttggtgtagctgtgtcagtatctttaatcttaattagtcctgcttcagccaaaagatgaataccacggttttcgttagtgacatcgttagctaccaaaatttggtcaccagacttaaattcagagatcttcttatatgatgttgaatatatacgaagtggtgttgtccaagtgtctccaatagaaacaatgttagtcttgtaagtcttgttccagttcttcaaaaaaggatagttttggaaagcattcagatcaatgtcaccatctgctaaggctttgttcggttgtgaatagtcagtgaatttctttgttttcaaagtaatgccgtacttatctttggcagttttaatagtggaagcccagatttcatcttccgcttttgatccagccattacaccaatagtaacggtcttagattctgtttttccttgtccaccaaatgacaggtaggccgcaccagcgataacgacaacggcaacaccagcgataatatagttctttttcttactcataataaattctcccttagtatctcattcttattttgaaaaatctttatcccaagcaggtagttcaacaccatcatattgcttattaatggctttcttaacggcatctgtttggtaagccttcacaacttgtttataagttttattgtctttatctttgctgtttgcggcaataatgttaacccattgatgtgaattcttgttgattggttcaacgaaaatagcttttttatagtccaatttagctgaatctgcataagtaccgttgattactgcgccttggatgtcagataaggtacgagctgtttgatctgcagctaattctttaattttcaaatttttaggattttttgtgatgtctttaactgttgcagtcgttagaccattttttaaatcaattaatccagcagattttaaaacatacagtgaccggctttcatttgatggatcatttggtacggcgattgtgtcgccacttttgaactgagaaaccttggtgtatgttttagaatacaatcggataggtgaaataaccgtgtcgccgattgaaacaattttattaccggttgctttatttgacgcctttaagaatgcataatgctggaaggcgttaagatcaatgtcgcctgcagccaaggctttgtttggttgtgaataatctgtaaattctttgaatttaattgtaatgccatatttatctttagcagttttcttaacagtattccaaatggcttggtcttgtttagagccagacattataccgatggttactgtttttgacgatgtttttgagtgctgcccaaagctggcgtaagcggcaccagcaattacaatcactgcagcaccaccaataagccatttggtttttttactcataatatatattctcctcaatattcccaaataacgtgcaaaacggatttttaaaacaaacaacagaacgaaacagttttgatgagttcaaaaaagccgtttccatatcatagtcatagatacagaaacggctaaaaaatagcgtgttaccattctgagttgtagatatttgttaccaaatatttgctcactaaccatcaggcatcgggagatgatcctagccgaatggtgtgcccggtaacgggggccaagtcgttgtaagcttaacggtaaaccgattcgcatacaccaatcacaggtcattttcacaatcgcactcacgctggctctcatcaaccgtcagctttcttagcttcgataaattgctacttttctgttcaatttgttttcgttttaaaaatcgttatagcctataataactagattatatttatttgtcaaatgttttatttaattcttgaataataacaagaaaacaacaaacataattatgctggaaccaagtagtgcgaaagtgccaaagataccagaaagaacagcagaagagaaggcaccaaccatgaaaaagacaactaatattgaaaatacccatgcattatgtagaaaaatatggtcacggttaataaagtattttacgagattggtacccacattacgtaaattaccagttgacataacgcttgtgaaaggtagaccacgtaatttggggaatgagtctaattgcattgctaatagaaaggatagtgccgatatgatgaccgtactagctaggtgatgattaaagacaccaatcattgcaataccaataaattcgatcaaaatactgtgctgttgtaaggataatttgccggctggaacaaaatgatttaatacagtattaaatgcagccccaagcacgaagaaaatgattgggataacaaaaaataaggttgctttccagtgtccttgggcaaggtggaatcctgcttggataatatttccagtttgtaagctagcaaatcgttcgtggtggtattcaaatgtgtacgagtcgataaaacccgaattcatgacgagcagtagaccaatacgcaatcgttcttgcattggatttttattcttcaatatcataacatctcctaaaaaatattattttaacacgcctgatttgctaatactagtaaaaaatagatatactgatactaccatttggagaggggaagttaattgataaaattgaagatagtagtatttatatttttgtttgccatgatgggtgtcttaacggtttccgcagatggcgattatcgtattactgatttgaatgaggttgtacgaattgatgccaatggggatgcgcgtattactaaaaaggtcacttatcattttgatgatgagatgaacggtgtgtattttaaagaatcacttaaaaaaggaactgattcacaatcgttacagtggggaggattaacttcaattgaggttagccataacaatggggaaaagcagactattttacctcgtcagggtgatagtagttatggttatgttgaaacaaaaaccagtcagcaggttcaagaaaaaatatattatccagttcaagaaaatgatcagttgacaatgttttatcattacactttaaaaggtgtcgtggtaaattgggatgatattgctgagataaactggttacctataggaactagggacgttgccatcgaaaaattacgtttggaatttgcactacctaatcaaccagcatcaactttaaaggcttgggtacatggtcggtcggtgggacatgttcttgtgaataagaaacaggcgaacataacagttaacagcaagaaaattggccccgatgataccgtcgaagtccatacttattttgataccagccagacaccgttgaatacgaataagcagtcaggtaaccgtgctgcctatattcaaaagcaagaaaaagcgattgcgttaaaaaataagaaatccctacagataaagaaagtaattggattcattgtttctccaattgttattatgatactcgtattcattattatgctaaaaactatccaacgacgaaagctattacaaagcgcgcgacaacagagcggtgtaactggtgacattgtccatatctttgatataccaaatgatattggaccagcgctggtcagcgaacgaattgctaaatcagttacaaatgcgaaacttattattgcaacactgctcgatttgattgcccgtcgcaaaattgcaatgacatatgacgatattcaaaagcaagatgacataacctattcagttttggatgaaacgaatttacagccatttgaattagttttcattaatatgatttttggtaagtatcgtagagcggttgtacatgccgaatttaagcagccagaatcaggggtgtcaaatcggattaaaaaagatatcagttcttttacaaaagcactaaaggaagctgaaaagcaggcttcaataattgaccatgtactgactaacaaaataaaaagtcagcaattttttctaacgctagccctaattattagtacaataatatctacttttttgttaggaatttttgcttatagtacacaagcatggtccatgtggtatgttatttttacggaaattattgttgtcatattagttcttatttttagtattaaaccagcaatattttataaggttcctgatggctttcaggaaaaatggcagtgggatggatttgccaaaatgttacacgatattgctcatttagagaataaaacggttttggacgtacaactttgggataagttgttggcctatgctatcatatttggcgaggcaaaaaatgtcgcaaaacaaatgaaagtttggtcacaaaaggttgatacagatgattctataatttttgtgccaatcatgttatatggcgatgactggagcgagagcttgatttataatattgaaaatgacggtgcttttcacgtcgataataatgtgaatggcgacggtgggggattttccgatggctcatcaggaggtgcagggggcggcagtgatggtgctttctaaaatgataaaatttccaaacaaaaatgacacgtacttagaaaaatttgttatactataaacataagttaatttctgagggagtaactgacggaatgatcgtggctgaatcgtcaaagcaaaacagcaatgttttatatcgcgctttattgcgccggtttagcattaaacagtgagactcatgtaaacacacttttatttgtgtttacatgagttttttcttttgttggtaaaaacttggaaatttatttgaaagaataaggagatattcaacatggcagataagccactctataatcaagataacacagaagtgttgtctcatttgcagacggatgctagtaaggggctttcgagttctgaagctaataagcgtcttgagcaaaatggcgctaatcaattgaatgaagctaagtcaacgaatttagtccaaaaatttattaatcaatttaaggacttgatgattgctattctgttggccgccgccattgttgccgcatttactggagaagtggttgatgcaattttcattttagctattgttattattaacgccatttttggtgttttccaagaagctaaagctgaggatgcgattaatgccctaaaagaaatgtcgacaccaaatgctagtgtaattcgtgatggtaaagaaacttcaattaagtccacagaattagtagtcggtgatattgttcgtttggaagctggagatattgtaccagctgatgtacgtttgattgaatctgcgtccttgcaggttgaagaagcatcgctgaccggtgaatctgtgccaatcaataagagtgcggaaacactgcaagagacagatttgcccctcggtgatcgtacaaacttgggattcatgaacactaatgtgacttatggtcgtggtgttggtgtcgtcacaggtactggtatgcaaactgagattggtcatattgctggtatgttagaagcaacggatgaaactaagacaccattgcaagcaaacttggctaagttgggacaagtattaacttatttgattctcggtattgctgtggtcactttcatcgttggtctagcacgtggtaaggaaacaattattgacatgttgttgacctccatttctctagcggtggcggcaattccagaaggattacctgccattgtaacaataaccttagcattagggacaacgcgtatggccgctcgtcatgcactagttcgtaaactacctgcggtagaaacgctaggctctacagatattatcggatctgataaaacaggtaccttgacacaaaacaagatgactgtggagaaattagtcgtcaatactgaaatttctgatgctgctactactgaagaattgacgggaacttacgctcgcttagcagatattctggctttaaataacgatacaaagcgaactgaaaatggttttatcggtgatcctacagaaacagctttgattgcttttaatgaaaatcatgggcgtgatttagataagctgtttacagaaatgccacgtgtggccgagattccgttcgattcagaacgtaaattaatgtcaactgttcatccggcaccgactgggtatattataactgtcaaaggcgcgccagatgaattacttaagcgtgcgacacgaattgagattaatggtgaaattaagccattatctgatgacattcgagcaaagctcttgtcgattaactcagagttagcaacgcaagctcttcgtgtacttggttttgcttataagacagttgaccaaatacctggcaatctggatacagaaacggttgagcaggaactagtatttaccggattcgttggcatgattgatccagaacgtcctgaagttgcacaagccgttgcagaagctaaagcagctggtattcgtccaatgatgattactggtgaccatcgagatacagcagcagctattgctattcgattgggtatattggatgaagcggataaagaaacagctgttatttcaggatctgatttagatgcaatgagcgaagagcaatttgcacaaaatgttgataaatataatgtttatgcacgagtagcgcctgagcataaggttaaaattgttaatgcttggcaaaagaagggcaaagtcgttgccatgacaggagacggtgttaatgatgccccagccttgaagacagctgatattggtattgccatgggtatcaccggtacagaagtatccaagggtgcttctgacatggttttggctgatgataactttgctacgatcgttcatgccgttgaagaaggacgtaaggtctttgccaacatacaaaaggctttgcaatacttattggcctcaaacttagctgaagttattgcaattttcgttatgacattgttgggctggaatatattggcaccaatcatgattttatggattaacttagtaacagatactttgccagctattgcattaggtattgaaccggctgaaaaaggtattatgaagaataagcccagaggtcgtggtgctagcttcttatcaggtggtgttggaccagcaattatttggcaagggattttgcaagctgtgattgtgttaagtgtatatgggtttgcgttagcagctcctgttcatccagaagtacatttggcgcaccaagatgccttgacaatggcatttatgacgcttggtttaatgcaaatgtttaatgccattaacgtaaaatctgtctatggctcaatgattgggccgcaagcattccaaaacaaaatgtttaactgggcattgttaggatctgtcttagtaatggctgcagttgttgttattccaggtttgaacccacttttccacgtatcacatttggatggttatcaatgggctattgtgttagtggctggaatgagtatcattgtcatcgtagaactggtaaaattgatacagagatcaattttcaaaaaaggataaacaacattggcaaaattcaaccccaaacaagcacaagtttacgtacaaacattgcaagaagtattaacaataactcaagacactgctgatcgtgtagcaccattttttacaaagttagatgatgcaaaggaagcgaatgctgttgcagatatccctgcagcagaattcgccgaaatcaaagcagaatttgaagacgctgtagcagcatatcaaaagaatgctcaaattttaaatacggttcaagcacctgttcgtttgttgggattgcataaatcattggctaaaaattatagtgcctatgctggagcaaccaatatgatgagcgaggcattaaatgttgccgatcagacagtagatgacgtattatacgttaaatcagaggaagaccaggaactttatcttggcaaaatacaagcaaatgtttcaaaaattatgatgggtgccggtcgttaagaacggtaacttgctattaatataaggtttgaaaaacgagtaacttactcagtaagttactcgttttttattacattaattttttaagtgtttgctgtgtgaaataaccattttctagctgcttggccaaaggaataatatttttttgccaattagcatattgtttttccgatattgaagaaatcctctcaagctcagacaaggagtcaataacaaaccctaggttgtattgaaggattaaatgaccaattgcactttgattccaagcaattaatggcaagccagcgcgcaaatataggctagctttgtgtggtgcattgaatcgtgtgtaggtttggtatgttttgtcctcaaaatcactatcccataataagccaaaaccatcatgaaaagcatctaaaatactggtagggtcgaagttttcacgatagttaatgtttgaaggaaaggccacgtcagcccaacgctttggtcttgaaccaaaaagatccattttggggccattataatgtttaagccacggagatttttgaaaagtacccgcaaagttaattttgtgactaaaagtagcttttttagtgacgtcacctaaataatcaaaaaaaggttgaataatggcaggtacgtgaatacccaatttcttaagttcatcatacattgcttgcgaatgaacgataatggtgtcgtagctatttaacacatttatttcccaaggcgctgttttaatcaagcgtaagggctcaatatcatgaatcaatagagcgctctgtgcctgatgtttactcaaggccgtgataagttcaagttcaaaatcagcgctcatataagttggaaattggtggatgacctgatcacccggatttaccatatttagccatgatcgaatcttttgttgacgtgtttcgctgtcaaaacgtccatcgttatagcgttctaaaggtaaaattttccaaccagttgcagcggcaattgatgcgtagtccgcttttgcttttaaagcacctggtggcatccagggttctattgtatgagttataaagtttgtcatagtacgattatatcaaaatccgaacatttttaaatgttttttgtcaaaaaacgaactataaaataacaaaacgttaaatattcggatataaaacagacttttaatcaaattctaagaaaaaagctgcttaaaaaacggataataagagcataaagaatatttggagaaaagatatgcaacgttcagcaaaaattggtattggtgtagcagcagtagtcgttattggtggtggtatttatgccgcaacgcaaaagtcttctactaaaagtacaggatacgctgtagctttggttactgatggcggtggtattgacgaccgatcatttaaccaatcagcatgggagggattgaaagcctatggaaaggctaacaacctcgaacaagggaaaggtggttataattatttcctaagttcagatacttcggatataaaaactaatttgcaaactgctgttaagggtggttacaaattagtatatggtgtgggattcgcagccgctcctgccgttactagtgtttctaaggctaattctaagactaattttgcgattattgattcagtcgtaaacaacaaaaacgtagcttcattgctattcaagtcagaacaatcatcttatttggcgggtgtcgctgcggcaaagcaaactaagtcaaagaccgttggttttgtcggcggtattcacagtgacacaattgacacttttgaagctggctttaaagctggtgtgaaagatacagacagcagcatcaaggtcattacgcaatatacagattcatttacagatgcagctaaaggaaagacaatcgcggcttcaatggttgcgaatggtgctgatgtgattttccaagctgccggtggcgcaggtaatggtgtgtttgccgaagccaaggcagaaaaccaaaagttagctgcaaatgcagataaaaaggtctgggtcatcggtgtcgatcgtgatcaaaaaactgatggtaactataaagataaagacggtaaagcgtcaaactttactttagtatctgcagttaagcgcgttgacagtgcggttgaagatgtggcaaacaaggcgaaaaacgataagttccctggtggaaagaccattacatatggactgaagcaaaaaggggtaagcttatcaaaggattcagcttcagaagatgtttggtcagcagttcagacggcacaaaagaagattattagtgggaaaatcactgtgccagtgcatccttaaaaacgaacagctaagtaaaaaattatcgattaataagtcgataatttttttgatgtaatattgaactcaaaaataaagaggccagtttctgctacaatttcttggatacagattaataacatttctaaaaaacagatgacttttcgtaagacataaacagattagctgcatttcagtatcaattgttatatgcttttagattaaaatctaacattatctggtctaaccaatcgtttttttgttatactaaatatattatgaaaaaaatatggataattctcacaacgcttgcagttagtttcattgcaatggcgtctgttacgaccgtcagcgcagcaaaaccaaactacatcatcacaacggatgcaacatatccgccgtttgattttcaagatagcaataatcaatatacaggtattgatcaagaaatcttgaaaactatcgcaaaacgtgaaggattcacgtacacattaaagcctatgagcttcaatgcggcaacgcaatcggtcacatcaggtcaagctgatgggattatcgctggtatgtcaattactgacgaacgaaaagaagtgtttgactttggaacgccttattataaatctggtattgcatgggcagtaaaaaaaggatctaatatcaaatcgttaagcgatttaaaagggaaaaccgttgccttaaagacgggaactgcgggtgctgattacgcactttcaattcaaaagcagtatggcttcaaggttacctattttaatgattcagatacgctatacaatgatgttgtgaatgataatgcacaggcaacatttggtgatttaccagtgttgcaatacagtattaaaaatggcacaaagttgaaagttatgaacgcgaagtcaccatatgaatcaggatggtatggattcgccgttaaaaagggccaaaacaaacaacttttagcttcttttaacaagggatatgcagcaattaaaaaagacggtacatatgacaaaattatcaaaaaatatcttggtgcaccagcatcggatttcactggtaaaaagtcggataataactcattattaggtattttaaaagccaacaatggggcgttcatgcgtggcttgtggcaaacattgttgttaacgattttgggtattatcttagcctcaatttggggcgtaattctaggagtcatgggtgttagtcaaaacagcgcagttcgtggtttgtcaacaacacttatttatattttccgtggtttgccattgatggtattggcattcttcatttatattggcttaccaggagtgattggaacaaagatacccgcctttacagcgggactaattaccttaatcttaaatgaaggtgcttatacaggggcctttgtacgtggtggctttgaagccgttgataaaggtcagatggaggcagcacgaagtctagggttcacttataatcgttcaatgcgtaaggtcatcatgccacaaggattgaagattatggtaccaagtttcattaaccaatttatcatcacgttgaaagatacctcaatcttgtcagccattggtattttagagttaacacaaactggaaccttaatcgtgtcacgtaattcgcaaggtttccgtgtgtgggctattgtggctgtgatatacttagtcgttattacattactcacgtggttgagtaattgggtagaaaagaggacacgtgcatgagtgaagcacaaactaaagttaaagtacatgtcgataaagttaataaatcatatggttcgaaccatgttttgcgtgatatttccttagatatcaatgaaaatgaagttgtcgtaatgattggaccatctggttcaggtaagtcaacattcttacgtatgttgaatcagttagaaacgcctgacaatggtacaatcgttgttgatggctacgatctttctgataaaggcacagatattaataaagttcgtgaaaatattggtatggttttccaaagcttcaatttatttaataactatactgttttagaaaatatcatgttggcacctgttgaacttggtaagatggataaagaaaaggccgaaaaaaaggcccgtgaattactggaaacggttggtctagctgaaaaagcagatgtatcagtgaattcattatctggtggacaaaagcaacgtattgctattgcacgtgccttagccatggagccagatattatgctcttcgatgaaccaacatccgctttggatccagaaatggtaggggatgttttggatgttatgaagaatttggccggatcaggtatgacaatgattattgtgacacacgaaatgggatttgctaaacaagtggcggatcgggttgtgttctttgaatcaggtaagattcaagaatctggtgtaccagaacaagttttcaatgcaccaaaaaatgagcgtttacaagaattcttgagcaaagttatgcatgcataatagcgtaaacaaaaaacaattaagtaagatggcttaaaatgccatctttttttgagagggaaaaacatgttcaaaaaaggtttcatccttgctgttacactggttgtagcactactatctttttcattggcggcagattgcattcatgccgataaaccacactatacaatttcaacagatgccacttatccaccatttgactttcaggataagaacaatgattatattggtattgatcaagatattttgaaagaaattgctaaacgagaaaattttacttatacacttaaaccaatgagctttacctcagcggcgcaactagtggctaatggtcaagcggatggcattattgccggtatggctattacagatgaacgcaaagaagtttatgataattcgacgccatattataaaaccggtgttgcttggattgtaaaaaaaggtagcgaaattaagtctttgaaggatttgaaaggtaaaacagtagctttgaaaacgggcacagctgcctctgaatatggtaagtcacttcaaagaaaatacggttttaacatcaaatattttaatgatactgatacgatgtataatgatgtcgttgtgggtaactctgctgccactttcgaggatatgccagtcattcaatatgctattaaaaatggtgtaaagctcaaggtaatgaatgccaataatccaggtaatgctggatcatacggttttttcgttaaaaaaggcgaaaataaagaattattggcatccttcaacaggggatttgcatcaattaaaaaagacggtacctacgacaaaattatcaaaaaatatcttggtgcgacacagtcaacgtttactggttccaagaaaaacaataattcagtgctaggtatcctaaaagcaaatgatggtgcatttctaaaaggattatggttaacaattgagctgactgtattggcaattattttagcctcaatttggggcgtaattctaggagtcatgggtgttagtcaaaacagcgcagttcgtggtttgtcaacaacacttatttatattttccgtggtttgccattgatggtattggcattcttcatttatattggcttaccaggagtgattggaacaaagatacccgcctttacagcgggactaattaccttaatcttaaatgaaggtgcttatacaggggcctttgtacgtggtggctttgaagccgttgataaaggtcagatggaggcagcacgaagtctagggttcacttataatcgttcgatgcgtaaggtcatcatgccacaaggattgaagattatggtaccaagtttcattaaccaatttatcatcacgttgaaggatacctcaatcttgtcagccattggtattttagagttaacacaaactggaaccttaattgtggcgcgaaattcacaaggttttcgtgtttgggcaatcatcgctattatttatttgataattattacattactcacatggttgagtaactgggctcaaaagaaaatacagtgataaggacacctctaattcgtatgatgaattagaggtgttttatgattattgcatgtgatagtaacaagaaatatgtgcgggccgacgaagcaaataaaagaaataattacttttgccctggatgccatgaaaaagttattttaaagaatggggaagtcaaacaaaaacatttttcacattgtgctggtgcggcatgcgtgacttttactgaaaacgaatcgatgcaacatttgtctggaaaattgcaactcgcgtctaaactacagtgttatggtgatgtgcaaattgaagcagttttgccagaaattcaacagcgaccagatatactactaatacataaccataaaagaatagctatcgagtatcagtgcagtcccatatcgcaaaaaaaactcgacatgagaaataaaggatatttcgctgaaaatattcatgttatttggattttagggcaaacttattttaatagaacaatgacacaaggaacaattatgaaattcatggctgataatgcattggttttctatttgcccgataaacaatattttgtacatcggcagcattttagaaaaccagatttttcacgtgtactttttgttgataaaataaatacaacattatttaatgcaaaagttccaaaacaaagaacgagattaaatattccaaaacaaatctataaactgcagagcttaattctacagcagcgagtcgatcctaagttggttgattatctatacaaaaagaatcggctgctaatggatgtgcccgtgtgggtacatggtggaaatacttttgggcttaaggtgcctaattggtattggcgtttgattactattctatttttagaaaaaataggtcaacaaaatgttgtgaaaaaggcagaattaacagttaagctaatcccttttttgttaggtgataatacatttaagcgacaacaaattgcagagttataccatgatctcgaagtacatgattacatcttgcagcaagagaactacatattagtgaggcgtctgccacagtggaaaaatgcgcgtcaacaaagtatagtgaaaatatgataaaatgattagtactgaatgataaggagtatgcgtttgatcgcaaattaaataattatgtctgaaaaacaactattacgtaatcaagtaccagaaaatcttacatgggatctatcctcaatttttccgacagatgaagcttgggaaaccgcttttaatgagacacgaaagtctgcacaagcattaagcaagtatgctggacacgtcggggattctgcggatgttttgaaagaagccttagaagcagatttagcagtagaacgtcaattcgaaaaagtctacgtatatgctcatcaaatttatgatcaagatacaactaatcaaaagtatagtgcatataatgctcgtgttcaaggcttatatgctgaattaagtgcgaatacagccttcttccagcctgaagtgttagcattgtcaaacgagaaactagatgcatacttagcgacagctggtttgaaaaaatatgcacacttttttgacgttttaaaagctcgtaaaccgcatacgctacctgcagaacaggaagccttactagcaggagcaagcgacatctttaatgcttctgaacagacttttggtgcattggataattcagatattgtttttggtgatgtccatactgaaacaggtgaaattgtgccattgacaaatggactctattcattgttgttggagtctaaagatcgttcattgcgtgaggaagcgttcacaacgctttatgatagttatattgctttacaaaatacatttgcctcaacgttatcttcacatgtcaagggacataactttttggctaaaactcgtcactatgattcagctcgtcaagctgctgtaacagccaatgatattcctgagtcagtttttgaaacattaaccaaaacagttgatgccaatctgccattactacaccgttttgtatcattacgtaaaaaaattcttaatgttgacgatgtacactcttacgatttatatgtaccacttgttgatgaaattaattttgaagtaacatatgaaaaggcaaaagacattgttttggcggctttggcaccgttaggcgaggattacatcgctattgttcaaaaggcttttgatgaacgatggattgatgtggttgaaaataaggggaagcgtactggcgcttattcaagcggttcgtatgatacaaaaccattcattttgcttaactggcagaacaatttgaataatgtttatacgttggctcatgaaatgggacattcggttcattcatactttacacgccataatcaagagtatcattatggtgattatccaatattcttagctgaaattgcttcaactactaatgagggattattaacggattatttgctaaagacaaatgatgatcccaagtttcaggcctacgtattgaaccagtatctagatggattcaaaggaacagttttccgccaaactcaatttgctgagtttgagcaatggattcatgaacaaagtgcggctggagtggctttgacagctgatgagatgagtacattctatggatcgttgaatcaaaagttttatggatcggacttatttccagatgaagctattgcttatgaatgggcacgtattccacatttttattacaatttctatgtttatcaatattcgacaggcgaagctgctgccacaactttggcagaacgcatactaacacaaaatggtgctgaggattataagaactatctgaaagcaggtaattcagattatgctttaaatgtgatcaaaaaagctggcgttaacatgagtcaaccggactatttaaatgaagctttcaaagtgtttgaagagcgattaaatgagtttgaaaaaatcatgttaaagtgaaatatttgtctattggttaaatagaaattgttaaccacgtatataaaaaacaaaactaatcagtccttgcggctgattttttgctaaaataatattaggagaaaatgatcatggccccacgaaaacttgtcgacgttgcaaatcaagcacttaacgatacatataccccttactctcattttcctgtaggtgctgcgttactcggcgaaaatggtgaaattttcaaaggtgttaatattgaaaatgtatcatttggtctaaccaattgtgccgagagaactgcaatttttacagctatagcagcagggcaacgccattttcatgggttagttatttcagggcgtacagacgaacctatagctccatgtggtgcttgtcgacaagtgatggtggagttttttgatcctgacatgccgatttggttgattaacgatcagggtaaagaaattgaaacaaatattgcagaactaatgccgggatcctttaattcattacaataaagaaagaagaataataatgtcacaaatctatcttgcaggaccttttttttcagatgaacaaatcgatcgtgtgaaacgtattgaagctgctcttgattcgaatccaactgttactgattattattcaccccgcaaacatcaaaagactgaaaaccctgaattcacctcaccatgggcggcagaggtttttcaacgtgatatcaagaatgtcacagatgcggacatgattttgtcgattattgattatcgtgatgatgatgccgattcaggaacagcctttgagcagggcatggcatgggtacaaaaaaagccaattattgtatttaatgaattgaagttcccagtgaatttgatgctatcagaatcactgactgcctacatcacaaattcggacgacattgcaacgtatgattttgatcaaacaccaaagttaccatttacgggagaactattctaatgaaaaaagtattagtagctaacatgacatctcaaaaagctgtcgactatcttgaatccaagggatatcaagtgattaaaaatgatcaggcctcagatgatgattttctggagcatgcagatgttgatggcattctaattatgatgcatccatttggtgaaagcttgatgtccaaaatgcccaatctcaaggtagttgcacgtcatggcgttggatatgataatgttgatttagatgcagccagtgcacatgatattgttgtgaccaacacgcctggagcgaatgcaactgcggtcgccgaaacggctatgatgcatatattgatggctggacgactgttttatcagcgtcgtcaagctattactgataacgcgaacaagcgttacctagccgcgcatcacggtcaagagttaactggaaaaacagttggtcttattggctatgggcacatcggccaagaaattaatcgtatgttgacaggatttaatgtaaaagtattggcttatgcacgacatcaacatgaggtaactaatggtcatatggcaacgctagatgagatatatgaacaagcggattttgtagtgacagcgcttccagcaactcctgaaacaaagcatatgattaatgcaagtgtttttagaaaaatgaaaaagagtgccgtattagttaatatcggacgtggagcacttgttgatgagagggcattggttgaggcattaactaatgaggaaattgctggcgctggggtagatgttgttgaaaaagaaccaattacagcggaaaatccattactacacttgcctaatgcatttgttacaccacatgtcgctatgatttccaaggaggccatggataatgtagctttgaaagcggcagaggatatcgttcgtgtcttggaaggtgaacgagctgtatttcaagtgaattaactaaaaatagggggttatgatggttaaaaaaacaaaaaatactgaaaatactttgtgcaagaacttcacctgtactttcgaacttttggggcgtaaatggaacggactaattattgaaacattgctgattagtggcgccaaaaggtttttagaaatatcacgtgctgtttcagggtgttcggatcgggtgttagttgagcgcttaaaagagttagaggctgcaaacatagtaattcgtcaaacttataaagattccaatttaattgagtataaattaactgaggcgggagaagctatgcgacctatgatgacagcaattcatgaatggtcagatcaattcaataacgttgctaacctggaagaacctgacagtgcaacaaaattttgatatactaaagaagcatacgatgaatgacccagtaattgtattgatgccctcagcgaacggtgattagtgaaagaccgtggctaagatacggtgaaattcagtcaggagtattggtttaatcgccaacggttgtctccgttatggacaccaaagctggatttatccaggaatttgggtggtaccacggtatttaacgtcccatgtagttcttttttggaagaattacatgggacttttaatttgtaaagtataggtgactggtaaagacaaaagttaatggtcacaatattgaaaggaaaaaatatgggcttaattgaagatcttacggctttaaaaaattcagcagtagaacgaattaatgataaaaatgctgatattgagcaattacgtgtgaagttattaggaaaaaagggtgagttaacaggtttgctgaaggggatgaaggatgtcgccgcagaaaatcgtaaaatggttggtgaagttggtaatgatgttcgtcaaactatcacagagttattgaaacaaaaaaaacaagcgcaagaagaatatgctttaaatcaacagttattggcagaaaaaattgatgttactctgccgggtagcgcgcatcaggtgggacaaccacacgttttacaacaaattattgacgaaattgaacaacatttcttgggccttgggtttgaaataatcgatgatacagttgattcaccagaagttgagactgatgaatataactttgaacgtgaaaatttgcctaaggatcatcctgctcgcgatatgcaagatacattttacattacgccagaaattttattgcgtacgcaaacatctccagttcaatctcgatcgcttgaaaaacatgatttttcaaagggaccactgaaaatgattgctcctggaaaagtctatcgtcgtgacacggatgatgccactcactcgcatcagttccatcaagttgagggcatggtggttggcgaaaatatcacaatggctgacttaaaaggtacattgctttccattatgcaagaattatttggtgaaaaacatcaaattcgcatgcgaccttcttatttccctttcactgagccatctgtggaggtagatgtttcctggaatgaagttacaccagatatgaatccagaagacattgagtggattgaagttcttggtgctggaatgacacacccaaatgtgttaaaaatggatggcattgatcctgaaaaatattcagctttcgccttcggcttaggaccagatcgatttgctatgttgaaatatggcgtagatgacatccgccaattttacttgaatgatgtgcgtttcttatcacaattcaatcgaaaggggaactgattatgaaaacaagcttaacatggataaatgaatatttggataatgaaattgacttgcacccaaaatcagtgagtgatttagcggaaaaagtagagcgtacaagtgtagaaatcgacagtaatacaacgattgcttcagggcaaaacggtcttgtagtagctaaaatattatcagtaattccacacccagattctgaccacatggttattactcaggttgaggctggtgagccagaaccaatacaaattatcacaggagcgcctaacgtagccgaaggacaaatggttattttagctaaagttggtgcacatattattaaccgtgaaaatggtgagctaattgaactaaatgcagttaaattacgtggagaattctcttatggcatgttagttgcactacaggaaattggcttcagtgacaaaattgcccccaaagcgtttgaagcagggatttatgtttttaatgaaactgatgatgttaaacctggagatgatgcgcttgtagctttgggaatggatgagccggtattagatactgacttaacgcctaatcgagcagatatgctatcaatgatcggtacagcctatgaatttggggcgatgttaaataagccggttactctgccatcatttgaactggtcgagtacgaacaaacagcagatagtcaagtttctgttcaaattgatgatcaagaactagtttcaaagtatgcgttgcgcgttgtaaacaacgtcactataaaggattctcccttgtggttacaaaagcgcctgtggaatgccggtatgcgtccaatcaacaatatcgttgatatcactaattatatgatgttaacctatgggcaaccactacatgcatttgatttggacaagttaaatggttcagatatttacgtacgccgtgcgaaagatggcgaaaagttggtaaccctcgatggtgaagagcgatcattgcgatccggtgaagacattgtcattgctgatgaatcagaaggattgatgttagctggtgtcatgggtggcatgggttctgaaatcgataataatacaaaaaatattgtgattgaaagtgccatatttaacccaagtttggttcgagcaactgcaagacgccataatttgcattctgaggcatcatcacgctttgagcgtggattaaactgggatgaaacacttaatgccttggatcatgcagctagtttagtagatgaattagcagacggtcaagtagcacgtggccaaattgttgccgctgataatgttcgtaaagatatccgcttgtcattgtcaacgcaacgggtaaataatattttgggtacatcattagaaacagatgaaattgctaacatttttgataagctgaactttgtttatgaaaaaaatgatgaaaaaattgttgttgatgtgccagcacgtcgtgctgatatttctattgaggccgatttaattgaagaagtagcacgtttgtatggttatgataacttaccagttacattgccttacggtcctacaacgtctggtaaattgtctagagagcaacgtcaaatccgtgctagtcggcatattatggaaagcttgggattaaatcaagcaatttcatatgtgttaacaacgagtgaaaaagcccagttatttgctgaaaataaagcagatggtgttgtaacattaaactatcctatgagctctgaccgtacaacggctcgccaaaatttattagcaggattattagatgatgtcagttataatgtgagccattttgtacctaacgttgcgttatatgaacaaggtcgagtgttcattgctaatgaacctaatgagcaaccaaaagaaattgagcatatagcgggagtagtaactggtaatttacaaaaatcatcatggcaagaatctaagcaagaaaaagccgttgatttttatgatatcaaaggaattgtagaaaattatttagatcagattggtgtcgataacgtccgttatattgcgacagaacgccatgaaagtatgcaccctggtcaaacggctgatatttatattggagaacaatatgtcggatttgttggtcaaattcatcccaagattacaaaaaagcaaaaattagcgccagtatttgggtttgaacttaatttatttactgtatttaatcatgtgacagatagtattcaatttaatcctatttcacgttttccacaaattagtcgagatgccgcattattagttgatcaggcgacaacaaatagtgaaattagtgcaacaattgtagagacagcaggggagcacttagttgatgtgactttgtttgatgtttatacaggtaacaatctgccagaaagcaaaaaatcacttgcttacacgttaacttatcaagatagtgatggcacgttgctagaaactgatgtgaattctgattttgaacatattatgagtgaattacaatctaaatttaatgtagaaatacgctaattatttttctaatgttatttgagttgtcattgtaaatacgatataatgggttgcagactataaagttataggataatttcatggcaaaaataatcgtacacggcggtaaacgcatacgtggagaagtcacaattggtggcgctaaaaattcaacagtagcattaatcccggcggccattttagctgatacaccggtgaaatttgatacggtaccacaaattctagatgttaaaaacctgcaattgattttgcaagcaatgaatgtgacgtctaagtttgaaaatggggtgttggatattgatccaacacgcattgaagaaagtgatttgcccagtggcgctattaagtcattacgcgcttcatattattttatgggtgcattacttggccggtttggccgtgcaacagtgactttccctggtggtgataatttaggcagacgccctattgatcagcatattaaggggtttgaagcgctaggtgccgtggtgactgaaagcaatgatattattcatattgatgcaacggatcatggtctaattggtgcgcgtatcgctttagatactgtatctgttggtgctactattaatatcgttttggctgcggttcgtgcaaaaggccaaacagttattgaaaatgctgcacgagaacctgaaatcattgatattgcaacatttttgaacaacatgggtgctaacattcgtggtgcgggaacagatactattcgtattgctggcgtaccgactttgaaggcacgcaatacgcacactgttattcctgatcggattgaagctggaacatacatgagtatggcagcagcatatggggatggcgtgacaataaaaaatgttattccagaacacttagaatcatatacatcaaaactaattgaaatgggtgttaaccttgatattggtgaagatgcagttcatgtatacaaatcagatgcattaaaaccggtcgccatcaaaacgatgccgtaccctggttttgctactgacttgcaacaacctatcactcctttactgctaatagctcagggtgaaagtactattattgataccatttatccaaaacgagtgaagcatattgctgaattacgtcgtatgggtggtgatattgcttcagctaagccgggcgaaattaaaattaatcagtcaccgcgcttggttggtacggatgttgaggctgcagaaattcgcgcaggagcagcattagtcattgcagcaattatggctgatggtgagacgatcattaacaatgccgatcatattttacgtggatatgatcgtattcaagagaagttaacaagtttaggtgccgacattaatattgaaggcatcgaccttatcaatctaatgccataatgtattgcgttacgaattaatatttggtatactagtttagttaataactgactctgggtcacgagactcagggcgctaaggagaaatgaacaatgcaagcagaaatccacccagattatcgtcaagttgttttcattgatgcttcaacaggaaagaagttcttgtcagcttcaactgtaacatcaaatgacacaactgattttgaaggtaaagaatatccagcaattcgtatggatattacatctgattcacacccattctacacaggtaagcaaaagtttacgcaagccgatggtgcggtcgacaagttcaacaagaagtttgctggatttggtttcaagaacaacgaagacaagtaattgttcttttagaagcgttcactttagtgaacgctttttatgtatgaggtgaaaattatcgcacgcacagttttaccagtaaaattaaatcaagagttgatcgttgtcgtcgatgatattcggattgatggtatgggtattgtttatgtcacagcaaagtatccgttgtatgttgctgatgcattaccaggagaaaaggtgcatttactggtaactcaagtagacaaattttctggctatgctaaagttcttgattggttggaaagttcagataaacgtcaaaatagtgaccggcagtatttgattgatgccggtacagcaccattagtgaacttgaaatatgaggcacaacttgaactaaaacaagcccaagtgaagagactgtttgaagaacagcatattgatgtgtcagttgaccgaacgattgggatggacaatccaacatactatcgtaataagactattgtgccagtgaaatggcagaatgatcatttgactagcgggttttacaagagggggactcatgatttagtacccatggatgattattttgttaacgatgcagaaattgatcaggcaattattgtggttcgaaatattctggagaagtatgatatcacagcatttgatcctgatttggaacgtggtgcgattcgttatataatgatacgtcgtggctattattctcatgaattaatggtcgtattggtttcaaacgaagaagtcatttcgcacgaaacagaaattattgctgatatccgaaaccagctgacagaattaaaaagcttgattttgaactatagtcccaaaaaagactacgttttgttaagtccaaataatcgaatactatggggcgagaaagcaatttatgatactttgcttgggtatgagttcattattggtcctaattcgttttatcaagttaatccgcaaaccaccgaagttctatatgatttagctgcccaaaaagcggatttgaagccgacagacactgttattgatgcttactcaggtattgggactattggaattagcgttgctagtcgggttaaaaaagtacttggtgttgaagttgttcctggtgcagttgctgatgcacaattgaatttacaggtcaataatatttctaatgccgaatatattttggctgatgcacctgtgcaatttaaaaagtggcaagaacaaggtttgaagccagatgttgttttcgttgatccaccgagacgtggcttaacgacttctctcattaacgccacaactgatatgtcaccagaaaaaatagtatatattagctgcaatccagtaactttgagtcgtgacgccgttgagattattgaaaatgggtatcatattgatggttcggtcttaccagtggatcaatttccacagacttctcacgtcgaaagtattacagtgttccgaaaggattaaaatgaattactcagtaaaaaagataggtcagatattaaatgcgacaacacaaatagattccaaaatagttactggtgtgtcttttgattctcgtaaagttaaatctggagatttatttgttgctctggttgctgaaaacgatgggcatgattatgtgcaacaggcgttgacaaaaggggccacagccgttttagtggacgacaggcatcaaatagattcaaaaattccagctattattgtatcagacacattgttagctcttcagcaattgggagaatatcgtcgtcatcaaattaatcctaaagttgttgctattactggttcaaatggtaaaacaacaacaaaagatatgacttcggcaataatgggttctcaatacaaaacctttaaaacacctgaaaactttaacaatgaaattggtgttcctttgacgttgctcactatgccagatgatacagaagtgttagtggtagaattaggtatggatcgacctggtcaattgacgacattatctgagttagtgagtccagacattgccatcattactatgattggagaggcgcatattgagtttttcagaacacgtgaaaatatcgctaaggcaaaactcgaaattactaaaggtctcaaatcacaaggaacattattgattccttacgatgaacctctcctgacaaatgcacaagttaaacaaaatgtgcaaacctttggacaagatattaaagatattaattcgtcatcctccaagacaatttttacttatcaaaatactcgatttgctattccactgttgggtcggtataatataatgaatgcgctcgcagcgatttcagcgggtatcttattacatattgaattaaaaaacgctgcagaagcgcttcagcattttgatttgacaaaaaatcgcacagaacagctcaccacatctcacggcgtgaacttaattagcgatgtttataactcaaatccaacggctgttgctgctgtcttggcaacattaaaaattataccggccacacacaagtatgttgtgttgggtgatatgttagaattaggcgaacaggctgcaagcttgcacgcttgtctggcagaaacggtgataaatgcgaatgttgatggcgtttacttggttggaccattgatgaataaatatctatatccaatcttgcaacgacgctttgattcagcgcacttgcaccaatatgaaacagatcagttagccgaattaatcaaagatttacagacgttaggtgaaaacggggacgtgattttgttaaaagcaagtcatgggattcatcttgagaacgttgttaacgcattggtaaaatagttttatgtgttgaggggcacaaaatgaaacgcagtcagaagcaacaatttaagatcagaaaatggtctgtgttcttaatattagtttgtaccatgggattagtgttatggccgaatcagttgaataacggtcaatatacgattaatccaatcgttgatgataagtatagtgctaacagtatgtcagcactaaaaagcaatatctcgccacaaaataaatttgctgagacattggataaaaaacttcagtcggaaaactatataggtacagcgctgattgtgcaccataatgaaattattttgcaaaagggctatggtgaggcagatgaaaaaatgcatcgtgataacgatgcctcaacactttttcagcttgcctcaattgaaaaatccatgactgctgtattaataatgcagcaaatagaatctggtaaactgtcatttgataccaagctgagtgattattatccgaatgtggtgaatgctaatcgtattacgattagcgatttaatcaccatgactagtggtttaagtcaacgtattcaaccgacgacatttgagtccgaagaagataacattgatttttctgctgttcatgctgttaaaattggtgaacctggtactggaatcggttggtcttaccagccggtcaattatcgtttgttagcaggtattttgatgaagctcactaataaaacgtttgccgtattgttgaaccaagtattcaataatacttatcatttaaatgtgagaaattaccaagatttcatcaattccaaacatcgttctattgggtatgataatagttacgaaaaagcttatagtgaaaatcaagtggcatacaaccgtgaaactggcaccggaaatgttgccatgacaactggagaattgtatcacttttatcgattaatgattgataaagttatcattaaacatcccagtcagttatggcaaacacgaaccggtgagacttatgctgctggaatgtatcacgagggaaaataccttaatgctcacggcattttgccaggatttgaacccacggttgttataagcaataatggacaagatgcggtaatattgcttagtaatcaatattataagaatcacagttttcaaccattagccagagaattatttacaaaaatgactgccattccaacaaagtaatggcaaacgcgcacaaagcgcaaggagaaaaaattttgaaatttagtgaattaggtttgtcacaagacattttggatgctattacaacgcatggatatgttgaagctacaccaatccaagaaaagacaattccattaacattagcaggacgtgatgtaattggacaagcacaaacaggaactggtaaaacagcagcatttggtttgccaatcttggagcacattgatttaaataataaaaacattcaagcattgattgtatcaccaacgcgtgaattagcaattcaaacagctgaagaattaaaaaagttgggacgcgacaagcgagttgatgtacaggttgtctttggtggtgctgatattcgccgtcagatccaaaatttgaagtcacatccacaaatcctagttggtacacctggtcgtttacttgatcacattaaccgtaagactgtaaaaattgataatgttcgtacattagtattggatgaagctgatgaaatgttaaatatgggcttcttagacgatattgaggcaattatttcaaagacaccagcagagcgtcaaacactgttgttctcagcaacaatgccaccagcaattaagcgtattggtgtcaagttcatgacgaaccctgaacatattcaaatcgaagcaaaagaattaacaactgatttggttgatcaatactttgttcgtatgcgcgaaaacgaaaagtttgatactatgacgcgtatctttgatgtgcaggcaccaaaattggcgatcgtcttcggtcgtacaaagcgtcgcgttgaagaattatcacgaggattagaagcacgtggttaccacgctgctggtttgcatggtgatttaacacaacaaatgcgttcacgtgtgttggctcaatttaagtcacatgaaattaatattttagttgcaacagacgttgctgcacgtggtttggatgtgaaggacgtatctcacgtttataactttgatattccgcaagatccagaatcttatgttcaccgtattggacgtactggtcgtgctggagctaagggtgtatctgtcactttcgttgcaccaaacgaaatggattacttacgtgctgttgaagatttgactaagaagcgcatgacgcctcttgaaccagcatctctaaaggacgctcgtattggaaagattaacaatgctgctggtgaagttgctaagttaattgatacaactgaggtttcagaaattcaatctcaggtagatgcgttgacagcaaagtatagtgctgaacaattagctgctgctgtattatctagcgttgctgatttagaaaagcaaaatacaccagttgaaattactcgtgaacgtccattaccacgtcgtaagggtggtaatggtggctcacgcggtggttcacgtaatggcggcggacgtcgtaatggtggtggcggtggttaccgtggcaatcgcgaacgtcgtggtaatggtgacacccgcggtaatgatcgccgtcgaggcagtggcgctgcttctagcgaacgccgttttggagattacaagcgtcgtgacggtcgctcaactgaaagtcgtcgcaacagtagtggcggatcacgtcgcgaatttactgtacgtgaaaaagattaataaattaaaatgctgtttgagacatctttgtatgatgtcttatgaacaagtggagctcagctattattgagttgttatccacacattttgtaacacgatgaaaccgtccaaacattttggacggtttttagttggagaaagtaaatgaaaacagttgaagatgccatatcttatattcataaccggccaaaaggtggtcaaaaagagtcattataccgcatgaccacattgttagcagccttgggaaatccacaaaatgatttaccatatgccatacatgtcactggtacgaatggtaagggctcagtatcaacgatggctagtaacattttacgtgtggcaggttatgatactggtttgtttgtttcacctttcatcactaattttcgggaacgaatacaaatcaataatgagatgatttcgaaagatgatttactgcacgctactaacaaagtcgcacaagtgttaataaacgttgatgcagaattatatccggatattcctgtagaatttgaagttttgacagcgattatgttcacctatttttcttcaaaaaaattagacgcattagtgatagaagtgggtattggtggtttacttgactctactaatgtgatgccaaatacaaaggtagctgttatcactagcgtaggattagatcatcagaaaatgttgggtaatacaattactgaaattgcatcacagaaggccggtattattcatgatgatgttgctgttgttaccggtgatttaccagatgaagcacgcttggtcattgaaaagaaaaccccacatgtcataaaaggtctgcgccatgaatttcaatccggattgccaggagaatatcagatagaaaacacagcgactgctgttgcagcagtacgtgcttttgctcagaatatttctgatgatacaattcaaaaagggctagaagagagccacttttcgggacggtttgaattaattgcaccaaacattatggtggatggtgctcataatgctcaaggacttcgtgctttatacaagtcgttgtcagtggcatatccaaaggaaaaaatcaccttgattattggtagtttgatggataaaaatgttactgctgaattcaatgaaatattgcgagatgacagatttaatattgttcttgtgccatttagtggacctaatggccgtcctagtttatccattgagcagacattaaaacagtatcaggtatctgcgatgccacattggcaagaagcggttgaaaaatcaaccgcggatttaacggtattgactggatcattatattttataagtgaggtaagagagcaatatgatagatgataagttatccccacgtttggtgctaagtgtcttagcgattggattgctgggatttactgatattatgttagaaactgccttgaacgtcagctttccaatgttgatgacagaatttaaggtaacctctagcacagtacaatggttgacctcaggtgtcatcttgttgacaagtatggtagttattttgtcgccatggttaaagaaaaacttcaccaatcggagccagtttattgttgccacggttatatcgattgtaggtgttctgattgatgctgtgagtaatacctttgtgattacattgttcggccggttgctacaagggattggtggtggcgttggcttaccattaatgtataatgttattttcgaacaagttcctgagaaaaagcgtggcacgatggtcggacttggctcattaattatttcttttgctccagcaattggtccagcttttggtggttatctaactcaaaattacggttggcatatggtcttttgggttgtgctgcccgttcaaattggttctctcatacttgggtgggccacaatcaagcaagtttcaacaattaaaaaagaaaaattagatattattggctggctgttgttaagtctgttttttgtctctggtatttttgtcatcgaaagaatcagcacacatggattagtaaatcttttaagtttattgatgactttggcgatgtttgtgggtattattggatatattctttatgcaaaaagagttgaaaatccattgttaagcccagaaatatttaagtttaaggtttttcgttttggtatagcagcggcatttgtagctcaaatagttaatctaacgtttaactatgcaatacccatggttctacaaattgttttactcaaaaacccacaagttgccggtttgactttacttccaggtgctttaagttatgctatgatggctataatttctggtcgcctatatgatcgatatagtgcacggctaccaattacaattggtgtgacattgatgtttgttgggacgttactaattgcatttatcccaattaatctcattagtttaacaggtggattcatggttattcagataggggcgggtttctggtttggtaacaacatgacctattcggtaagcagtgtaccagttgaatttcaaagctcaggaaattctattttttctgcaacaacgaactattccgctgcagttggtattgcacttgctgctggcattattgctacatttcaaaagcaagcaattaacgtacgtgagttggcttcatcaacacacattggtgcattgtggacatttagagtggacatagtactgattgttttagccgccattctttcattaagtgctttaggttctataagaaaatagagagaatgacgtatcatattgtagaggtaaacaatatggtcaaagaaaaagtagagaaattttacaatgttttggggtataaggaaaagaaagatattcgtatttttcaacgttactttccaaataactataatttaaatgaattgacaaatgatatagtggaagattttttgtctcataatccgattgctaatgaagctttgctgttaggaattgaaattggcaaacatgttgcgcaccagcgacggccacagttactaaatgccaaatattcagcagcaataggccggtttgcgcaacaacaaattggtaatttaatgcaggaacaattaagtgtagctttgcttgatacgcagttgaatgttatcggttgggaagtagtctttgtgggtactttaagtcaagtacaagcttcaccacgagagatatttcaacgcgtactaaaagccaacgcatttggattcatgattgcacataaccatcctagtggtaatattatgccttccaatgcagatattactttcagtcagcgtttggcaacaattggtcatcaaatggatttacgtttatttgactcgtttattgtgacacaaaatgagtattggagtatgtcagaaaatcaacaattaaaaaaagttatctgatttttcagataactttttttatttagacagctacgggcgctttaatggccggttcactatcgtaatctaatattttgatgtcatccatcgtataatcaaacaatgatttaacttccggatttagccatagttttggtaatttgtgcataggccgtgacaattgttctgttatttgatcaacatgattattgtagatatgcgtgtcaccaatggtatgaataaattcaccaacttcgtagccagtttgagctgccaccatgtgtagcaacagtgaatagctggcaatattaaatggaacaccaaggaaaaagtcaccggagcgttgatacatttgcaaactgagtttaccgtccgcaacataaaactgactaagtacgtgacaagaaggtaagggagcttgcggtgtggtctcagcattccaagctgttaaaatgaggcgacgtgaattcggtgtttccttaatttgatcaataagtctggcgacctgatcaacggtttcatcaccggcggtcagactatttgtttcccagctacgccacaattttccataaacatttccaatataaccaaattcttccttgaattcgtcatcattgagaatgttgttaacgaaaatgtctttttgttctttgtatattttggcaaaattttcatcagtttgtgaacgaagaccaaaattagtcatatcgggaccggtatatttatcagattcaatccactttttaaacgcccattcatcccagatatgattattgtgttcaagtaagaatcggatattattatctcctcttaagaaccataaaagttcacttttaatcaaaccaaagaaaacctttttggtagttaaaagggggaatccttcagccagtttaaatcgcatttgtgtaccgaacaatgaacgtgttccagtaccagtgcggtctcctttatgtgatccttcatcaagaatcttttgtgcgaggtcgagatattgttgttcattttgagacatatgtcaaaatacgtaatgtgcgcgactgaatcattggcatgcaatgcctccaggcgattccttatcaaacacatttcctttcaaaattaatctttacttaaaatactaacgaaaaccccgttaaatagcaaatgatttaacggggttttcgatgtgatatctctttctattggattaaaaaacgctaaggtatatcgtattcatacaatgaattggttcatatcaatttgctgtgctgtaagtgcagaaagtggaacttgttttaattcaattcctttttgtgctaatagttcttcggcaaaggtattatttcgataatctctcataaaataaattttattgatgccggcttgtaaaagtaatttagtacattggacgcaaggtacgtctgttacataaacttccgatccatcaattgttatacccatttttgctgcttgcatcaaggcgttttgctctgcatgaactgctcgaatacagtgaccgtcaaccatcaagtcaccaacttctgtacagtgaggcgtgccagatacagagccattgtacccactggcaataatgcgatgatcacgaacaataatggcaccaacgtgtaatcgcgtgcaggtagatcgtgtggataaaattgctgcttgtgcaatgaaatattgatgccaactaatgcgttgatctgccatgaataacttcctttatcaaataaatctgttagaatgataataacacatttttatttgaaggagtaaaaaatatgacagagattttagatggtaaggcggttgcaaaaaccatcaatgaacaaacaaaagcacgtgtggctaaacaaaaaagacctgtcactttagcagttatttatgatccttcaaatgatgggagccaattatatgttggcatgaagtcacgtcaagcagctaaactcggaattgtaacgcgagatataccaatctcaactgatgcaacaacagaaagtgttattcaattagtagaagagctaaatgacgatgaaagtattacaggaatccttgttcagagtccgttagccaaaggaattaaagaacgacaaattttttctgctgtggcaccacataaagatgctgatggtctaggagcaacagttcaaggaatgctattcggtgattctttggaaaattatactgttgcggcaacgcctcaaggtgtgatgacacttttggcgcaatataatatttctttaaaaggaaaaaatgctgtggttgttggccgctcacaattatttggcaggccaatgtttgctttgctcactaatgcagacgctacggtaaccttagcacaccgctatactgaaccaacgaccttaaaggcacttttaaaaaatgcagatattgttgttgttggtgttggtattccaaactttattcaaggtgaagacctgaaaaagggcgctacagtaatcgatgttggtatgaacgttgttgatgggaaagccacgggggatgtaaacttttcctcagcccaagggattgccggttatataacccctgttccaggtggtgttggaccaatgactatcgcaacgctgttagaaaatacagtaacactagcagaacaacatcaataaaacgataaataaaaaagcatctggcatatttgtcagatgcttttttgtgcgaaaagatatctaaactcgtatgatactgtgagctcaaaaaagagaaaggagttaatgatggaaattgatcaattacttgataacgctgttgctgaggaagctagtgatatttacatattgcccaacgatgataggtttacgataaagtttcatgctggtggttcaatagtaactcaagaatatctggacaataaagctgctgaaaaaatgatttcagctattaaataccgtgctaagatgaatatttctgagcgacgaaggccacaactcgggcgttttcaaaaacaggatatttggatacgtgtttcaactgtgggagattttttgaaccgagagacagtagttttgcgtgtaatttatccagagcacaatacacaaaattggttggctgaaaagcagtttgatgatatgaaattaaagttacctgattcaggattgtttttaatctcaggaccaaccggatcaggtaaaacaacaacactttatcatttattaaaaagcattgcggaaaataaattagtattaaccattgaagaccccgtagaaattaatgccccagagtttgtgcagttgcaggttaacgagacagcgggcattaactatacagaattaattaaagtagctttacgccaccgacctgaaattttactaatcggagaaattcgtgatgttaaaacagctcaagctgtgatacaagcagctttgagtggacatttagtatttagtactattcacgcaatgtcaacaaaagacgtcgctttacggttgttggaactaggtgttgataaaagtcagctcgaagcagcattaacaaaaattgtttatcaaaggttagtgcccacgatagacaataaacaagcagctgttgctgatgttgtagaaggaatgcctttaaaaggttcaccaaaatttactaatagatggcgagaaacgcttgcggatgccttaaaggaagggaagataacaaatgaaacctatcaaaaatttagcgcgctttaataagcgggaccaggtattattttttcaagagctgggtgagctactatcatcaggatatagtatcgcacagagcattgatatcttagctagtgcacatcaaaaatggcaatcaatccttagccaggttcagaaaggtctatcaacagggcaaacattctatcaagccctcgaggcatttattagtccaaatattttattacaattgcggttatcagaccaacatggggatatttccaatacactggttcgaattgggcagacccttgccaaatttcagcaacaacaaagcaagttatcacaggtcatgcgttatccaattattttactgggtatccttggtttgttgttgattggactaaaatgttttttataccctatgatcaatcaatggcgagaaactaatcaagagacgatcaattatccatatgcatttattttctgcaccggtctcttaactttaaccttcttaacactgtggttatggtattggcatcatttatcatcaattcaacaattaaatatactggctaaagtaccatttgtggggacgctagtgcgcagtattgttacctatcaagttagccaacaattatcaatgttaatgtttagtggactaacgttaccagaaattattgatgaagttgcacaacaaaataataaatcatacgcagttgcacttgcacatgatattcaaaagcatctcaaattgggaggcaatatcgagaggtatatattatcacagtcatttgttaatgattcattggctggatattttattcgtggtcataaacctaagatacttgctcgatatctcgattattatgcaaaaacacaatttaaattacttatgcaacaaacagaccgttttattggcacgctgcaaccattattttttggtattatcggcgttgcaattgttggtctgtatatgagcatgctattaccaatgtatcaaacaatcggaggactatatcaatgagtatttttaaaaaatcgaaaaaagcatttacactaattgaagcagcaattgtactctttattattagtttgttaatgttacttattttgccaaatttaaatgcacagcgtaaacatgcggtagaaaaccatgcgacagcgatggtatcaactgttcaaacacaaattgatttgtatcaaaatgatcaccccaatcaggataatgtgacactcgctgcactaaaatcagaaaattatttaactgagaaacagtttcaaaaagcacaagatcttaaaataacaattgttcataatgaagcacgtaaatagtgggttcacattaatcgagtcagctgtaacattaatgattgtgagtttgctgctttttgttggagcacaaacatcggcgcgtcccaaaatagacacgcaacaatggttagcaacatttcaaacctactggcaaaacgcaagactaacggcacaacatgaacaaaaaacagttgaggttatttttgataagaaggaggtgagatttaataatcaagtactggtttatccatcaggtataaaaaaagatacgcaacaaagaataaatgtcttaacaacaggctatgttgcaccaaccacagtgacactcacaggagaacagacgacaaaactaatatttagtcttggaggaggagaatatcgtgttgaaacaaataattcaaaataagcagtccgcatttgttttggcagaatcaatgttagctttaatactagtatcagtatgcatgtcatttgagtatgaacaagttcaccaatttcatattcacaaaagtaacttggaaaggaaattaaaagttgcagaacgagaacgaattgatgcaataaatcagtgggaagggtgtaatgaaaaatgatgggtttacattgctagaagccttgatatcattgcttatagccgcgttagttttgacttctttacaatttgttgttccgtttttaaagcaaatttctgatgctccaaaggcaacagtcctgcaaacgatcacgcatcaacttgaaactcaaaaatataccataacctcagcaacattgacatcagttagacttaaaagctacgagggtaaagatatgtatcttgaagtcaaaaataataaattacaaataagtggcagtggtgcgggtcagataattttaatggagaacgtaacaaatctagcggtggatgatcgcaataattatttgaatttaacaattacaactaacaaaggtaaattttcaagtatattgcatttaaagaagacggtacaaaatgaataaaaaaaatgcctatgttttagtaccaaccatttttgttctgggggcattaagcgcgttatttattttgcagaatatggcttttaatcaacagttgcgggcacaaacacatttgatcgaaatagcaaaaattgacaagatacaaatgattgtcagtacgcaagtatacaaaaataatgagaccaaattcaattttgatgaggctaaagtcaccgttattaataagcaaataaaaattgacttaggaaagcgtatatatcagcgtgaattgcttgtgaaataaccttgaaaattggtcctaaaaccgctaaaataaacctatgacacaagaaaaaatagcacaatattttgatgctttaactagcgcttcacaatctttggttaaagacacgaacatcagttatatcgatgcactaattgagatacttgaagatattaatttgcagactgtccatcgcgagtttgataagccaagtaacgatgtggtgcaaataatacagtcaacaattgatatggactggtctttattatcaccagctgaaaaacgcaaagcattacaattggctgttttgaaagctaatcgtgaagatcaaactcctgctaattaccagattacccccgatggaattggctatttgctggctgattttattaaccagacagctgggttacgagataatgatactattatcgacatgaatgttggttcaggtaatcttttatggacaataaatgagatgctagatgtgacagttaaacgcatagggattgataatgatgaaacacaactagcgctcgcgtccgccacagatgaaataatcaatagcgatgaaacaactctatacaaggaagacaccatcggcatagaagaggcccctaaagccaaagttgttatagctgatttgccagtcgggtattatccactccagccaagtgacaaatttataactcgtaatcaaaatgggcgttccttcgttcatcacctacttattgaaaagtcattggattttgttgcagatgatggatggatatatctacttgtacccgcaaatgttttgaacggcgatgaagcaaaaaaagtattacaatttgttacgtcacgggcacagctaaaagcatttctacaattaccaaacgaatttttccaagacgcgcgtgcagcaaaagctattttagtgcttaaaaaacaaaggactaaaaataatgaagtgctcatgggccaatatccttcgctcaaggatctaaaatcattgcaaaattttttgcaagaaatcaaagcgtgggttaaactagagaatgaacaaaattgatgtattcgtggcattgtcacttagaatttaggtaaggaagaaagacaggtaaaaagaatatcatggctaaaacaatggctgttaacgcaggtagttcatcactaaagtttcaattattagagatgcctgcagaacaagtaattgcacaaggtgttatcgaacgcattggtatggacgatgcaatagtaacgattaaatacggtgcagaaatcaatgcagagcgcttggttggccattcagaagatgacgaacatattactttgtccaaagacggcaaaggtaaaaagtacgaaaacgttactgcaattaaaaaccaccaacaggccattaacttcatgttgcaaaagttaacagatctgggtattattgaggactttaatgaaattactggtgtcggacatcgtgttgttgctggtggtgaatggtttaatcattccgtggtggtaacagatgatgtgctggctaaaattgatcgtcttgcagattatgcaccacttcataacccagccaatgctatgggaattcgtgctttccaaaagctcctccctgatgcattgtcagtggcggtttttgatacttctttccatcaaacaatgcctgatgaaaactttctttatgccttgccatatgaatactacacgcgttatggcgcccgcaagtatggtgctcatggcacatcgcaccgatatgttgcatcgcgtgcagccgaattgatcggtaaagatttaaaaagcttgaaattaatcacgctgcatttgggtgcaggtgcctcaattacggctattaaggatggtaagtcattagatacttctatgggattttctcccttagctggtgttgctatggcaacgcgttcaggagatgtcgatgcttcgcttgtttattatattcaagaacgcgaaggactatctaacgaagagatgttaaatatattgaacaaaaagtccggtttgcttggtatttcgacaatttcaagtgatatgcgtgacttgttagatgtccaagacactaatgagcatgctgacatggcgattagaatatttattaatcgtgttgttaaatatgtgggacagtatgttgctgaaatgggaggcgttgatgctatcgtatttacagcaggaattggtgaaaactcagtcccagttcgtaaaatgattattgataaattaaactactttggtgtgaaattagatgaagaaaaaaataatgttcgcggcaaagaagttgaaatatctacgaatgactccaaggtaaaagccttgttgatcccaaccaatgaagaactaatgattgctagagatgttgaatctttgaaagcatagttagatgtagagtatgtggacggctagtggacaacactagccgctttattacgctgtaagaggtgagatgagatatgcagtctagaaaagaaagacatcagcatgagatcaaaaatgctgaggcgattgagaaaggcctcgatccatttgctgatacaatgaatagtgggaataagggcgatagccctagaaaaaaacgtaaaaagcctaatcgtctgatattacttttgttacttttagttatagtgataggtctgtttttcggattaaaagtgttattgacagataatacagctgcattagatccgaatgacacaacgtttaaaactgtgaaaataccatccggatctacaccctctcagatggcaaaagcattgcaaaaacaaaaagttattaaaagttctgaggccttttacaaatattcattaaagcacggtgccgaagatctccaagcaggcacttataaaatatcaccttctcaaactgttcaattgatttttaaacagttgacgatggggcctaatgccggaccacaattgggtaaaggatatgttttggtagcaacaggtcaagatcaggcggctattgccaaaaacattgccagtgagactaaattgtcacaagataaagtgaataaggcatttagtgataaatctattatttctaagatgaaatcaaagtatccggatttattgaaaaatatgtcttctaagagtaacttggccgattacgtttacccagcagcatacgatttaaataaagtgacagatgttactgatttaatgacgaaattgttggcaacttcagataaacaactaaagtcgtattataaagacttgaacaaagatggtataaataagcctgctgttataacattgatggctacttcgggtaaaagcgaatttgaacatcgtttggcttttgtcaataaaattgcgccatatgctcagacactcagtaagaaatatggtatcttagcatcaatatcgatagctcaagcggcacatgaatcaaactgggataactcaaagctatcatctaaatacaataactattttggtgttaaaactcaggatgagacagcaggaaaatcagttgttttggagacgactgaatatgttgatggaaaacctgaaacacaaaaagcacgttttgctgtgtatagtgattggaaagatagcatgaaagaacatgctgagacattagtgaatggtaatacttggaatcctaatcagttccaagatgtattggatgcaaaaaactacaaggaagccgctaaagctctgtataaggattcatatgcaaccgatgttaattatccaaaattgattataaatttaatcgagacatggaatttacaacgttttgataaataaaaaatgtacccgatcatctagacattttagatgatcgggttttaatatacgatataactgaatatgttttcaatttttatttcttatttaattttaatatttaaaaaaaatgatgtaaattttcaaaaattatcgtgtaaatgattgtattgtacttaataaaagtaagtgcacaccaatagtaataaagattatcagtaattttataacgtaaactttttcatgatttttattcaaaatttttaataaattaacaagtatttgaaaacgtttacagaaattgtaaaaaaagacttgtgtaaacggtttcactaatgtaaaataaacagtgttaaaaaatgatgtgttgcagaacatcatatgaaaaaggagcaatatttagcatgagtttagcaattttactggccctagtgccggcactagcttggggttccgttggaatcgtcaacacaaaaatggggggaacagcagggcaacagaccttaggtatgacttttggtgctttgatatttggcctagcaacaatgtttttctttgtcatgccacgccacatcgaattaagcagtcatatttgggttgtcggtatcgtttctggattggtttgggcagttggaacagcaggacaatttttggctatcaaggatttgggcgtttcgcttgctattccattgtcaacagccggtcaaattgtagcaaatgctttaatggctgctgctgtcttaggcgaatggaaaactgctaaaatgtgggcaattggtgtgatttcaatcattacggttgttatcggtgcaactttaatttcagcacgtgataaatcaaaaaacagcgcaggaattgaagcacaagagcaaaaaaaggactggactaaagggcttatctacctgattgtttcaaccatcggattcatgttctattttgttttaccaaacttcttaaacaaagttggttacatctctgatgccattaaagcacgtggtaatggtgtcgattatatgaccgccattgttggaccacaagctatcggtcaagttattggtgcctttctaattgttgccttcgttttgaaagaatcaagtatcatgtttaagttaccaacttggcgtaacattgtaacaggtttagtttgggctgctggtaatattttcatgttcatctcagctgccaatcctgatgttggtcaaactatcgcgacaacattctcacaattaggtattattgttggtacttttggtggtatctatatattaggagagaagaagtcaagttatcagatgaagttaattgtgatcggtacaatattagttgttattggcgcaattatcatcggcaatatttatactttcgcataatataaaacgtctgaaacattgttcagacgttttttaatgcaataaaaaagcacctaggcaggtgctttttgaatactgaaattatttagttacgttaataatttcaacgtcaatgctaataccatttggtaatggaacagcaacggtttctccgacctttttaccaattaaggcattagccattggagactcgttagaaatttttcctgccaaaggatcagcttctacagaaccaacgatagcatatgtttcaggttcttcatttggtaattctttgaatgtcaccgtcttacctaatgaaacttcgtccttagctgttgcattagaatcaatgatttcagcattatcaatcatattttttaatgtttgaatgcgtccttcaacaaaggcttgttcatctttagctgattgatattccgagttttctgataagtcaccgtatgatcttgcaatctgaatacgttttgtaatttctggtcgttgattagcaataagatcttccaactcaagttgaagcttgtcacggccttcagcagtcattggatatgttttttcttcagacataagtgtttcctttcaatttgcgcttttttccgcaaaatataacggaaaaagcatatcatgtgtggattttttttgcaatagattttcgattaattattaataatagcaataaggcgagtaagctaattattacaccgtaatagaaaagaggtggtgtatatacaaaggatattttatgaaggccaggttttgtttttactgctataaaataattagctactttggtcgttttgactgttttaccatcaaccttaacttgccagcctggaattgacggaatagttgtcataacgagtggcttttttgtcgttgttttgatagtgccttcaatgcgtcgctgcgagcgtttgcttatctttagaccattctgtttcaaattagtcgaatcattggctattcgctcattatcgatgtgatacagagtcacatttgtcagcgctagtgtttgggtatctttaagcctaaacgtgatagtttgcagtttatctttggcatttgtggccaaattaacaacaacagtgtgtcggtaagtattgaattgtgtaattatcttgccgttaattaataaatcaaaatttttaatgtctaatccgctgccgatcgtcagataataactatcattatttgtgggcgtaaattgtaagtcaagacttgcaggttttgcagcattttgtcgagtgataattgaaccagtaatcatacttggtgcagtaagattatgtccgatggacttctggaagttatctacatgaacagttgaggttgttgagcctgttataccttgccaaagattaccttgattttggagtggattattgaaaagcattttcgtattcaatgcaccagagctagctgcaaatgcgagtggcaaagcatttttattttgataaacatttgtggttttggtagtggccttaaggttgtattttttgctatcaggacgaaaaccaattagatgttggctaggctggccagcgtctccattatctttgccatttgccgtgataaaatacttcatccccaaaaaggcatcggataatacgctaccattactataaacaacgtaattatcaccatctggttgaccaaaattaccaaagaaagttggtgttgcctttggtaaagcagaactaaaatgagcaccaccataatagttaagcatcattgagtcgccacgtgtgcgctggaatgtttgtgccacgcggtaccatgaacgatcttttttaattttttgatttgcgtcggtaagggcgtgaatggcattctgatattcggtgtttgtaagatatgaaaaatgattcagtgttaatgctacattggcgccaagggaaacgatggtgattagactaagtatcggcaaccaaatacgatcgtgacttttaaaagtaaattgggctagggttaataaagctaatccaataaaaatggcaatgctattactgtctgtgtagcttgttttttgatcatttataaacgcatataccgcgacgcctactaaaaagacaaatagcaaaacaagtgttattttttgaggtcgccaagtcggctgccaactcattgcagctaagtatataacaaaaaaactaattagaaaactaaaccggtaaggataccaaaccggatattgaaaaccatgaaaaagcaaggttaagggcgcccatgttgttgccaagatgagaaaactcaaaatagcaaacgcaccaactttgacacgccaatgtatgacacgagtggtaataaaggtaaccaatgtgattaaaataaacgcgctaacataaaaattggcttgaccactctgcatctggtcaaaatcaaagctgcccggaattaacttgagaaatagatgcaaaggattgttatcaaatttgaaagaaaattcggaattatattgtgatttaccaagcgtcaattggaagtaggtgggcaaaataagccacgcggataatgcgccaccaataatagaaccaagagtaaagtgccataaaatagttagacgatgtttaacattaggccatgtgaggcgccacaaaaaataaagaacaataaagatggctaccatgaagccaatataatagttcgtgatgatagtaatagcaagtaagacgctataacgccaccatgtttgacggtagaatacttgttcaagctgataaattacaagtggcagcatgacagctgtatcaatccataataggttgagattattagcgacaaaccaacctgatagagcaaagttgatggcaaagagggtaatatagtagccatgttgtaaatgcaatttttttaaaaggtaacccattgagagaccagctgcactaatctttaaacagataaccaatagaatcgcagcaggtaaattagcgtttgatacaaaaagaaaaatgaagttaaatgggctcatcaaatagtaggcccattcacctaacatatctccacctagtgcgtttgaaaatgaatagaagaaactggacgggtgttgtaaaatagtgtatttgaatgctgcaaattgatcaatgtattgttgaccaagatcaacagtcaggatagagttggaaccaaagggtgccatttttcgataagcaaaatatccgattagaacaagaaaaggaatccagaaactgagtgcaagcggtgaaattgtgtattttttaattttacttttcataagtattagcataccaaattttatttaaattgagaaaaattaaaaccagaatcttcttccgtattagaaaattctggccaagttgttgttatttagttgaagaaatcgcaacagattctgcaatatgttgttcgggatttaataatagctgtgcaataaattctgcgacgcttgttctagtgattgggccaccaataattttttcgtgaggatcagtttggacattcagttgttgcattttattatcatctgttaattcattgggtcggatgattgtatagtccaattgggactcttcgatgcgcttagctgcagcagcttgatcgcccatgtaggtgttttcattgtctggggtgcccaaaatattacgccaaatgtcagcagtttcggtagctatctcattgtaaataccgattgttgcgacccaaattaagcgcttaacgccggcagtgtgcattgcgttaactaaggcattagcggcgtttttttgtcgaccttctgcaccaatatttgcataaacaatatcaatgtcttttagcgcacgaaccaagttttcttccttggtagcatcaagtgatttgattgacttttcagggcgagcatgaagagaagttaatgtaatttttgtatcggtatttgccagtatgtcaaccacaattttagcaatttgaccgttggcaccgaggattaaaatgttttttgtcatgtcttcattttagcacgattgtttgtgttgcggtagaatatacttagaaagggtatagaaataaacgtggtgataattattagcttttagacacggttaactatacataaaacatgaggtttatatgagtttaacttatcaaaaattactagtagctgtacctttgattttgcgtggcggtaacgtaccgacgattgtgggagaagctggaattggaaaatctgcccttgttgctgaaatagctaaaaaattgggtgcaaaactttttacaacagtagtttcattatctgaaaaaggagatttagcaattccaattccacctttgaatgagacatcattcttgcaaactaaaaattatggtcgattggctgatatcaaatttggttatacacacactttgatacaaattatagaacaagctgaagtcgaaccggaccgaacaattatctggtttttagatgaattcaaccgaggatcacaagcagtacaaggtgaactaatgaatcttgttttacagcgacagattaatgatctggtattgcctgataatgttaaactcattctcgcagaaaatcctgatgattcaatgcaagggtttgagaatgccgaatacgcggttcaaacatctgatgcagcgattaaagatcgaaccactcgacttgtcatgactgtttcagttcgtgattggttgcagtgggccgcatctggaaaaaagcggccgcacatacacgacttggtccgccaatttattgccgaaaatgccgaattattgtacccaaaaaatcgagatattgacttgaaccctaccccgcgtgcgtggcagcgcgtatctgataatttattccagttgcaaaaactaaccaatgagcagcaggatgaactgttatttgatatcgtggcaggagatcttggggacaattgtgccacacaatttgtgacttttgtccaagaaaaaacaactagtctaacagctgaagatgtctttaattcagtaccaagtggtccaaaattaccacagacaatacgtgaaaaatttgagagcttttcagaaattcaaaagctgaacgtgatgaaaaccttattattaacggcagatatgagactagacaataatgctggacgtttcagtgagttactcaatttgattgctcccgatggacagtatgcactggtaaaacaaatgacgagcgcgccaattttggatgatttatatgcttctgataatcattatgccaacgtgttatatcaacagattatggatattgctacacgatgaaatcagagaatgacaatctaattattgatggtattaaaacattgctcgatgtatcgcccctctacggcaatattgtgatgaacttagtccgagaggtgaacccacaggctgctaatccattagcgttaaaatggcaaggacaccattggtacttagtggttaaccctaatttattaacggctcgttttacatcacacaaccaggttgctgctgcgttagctcacgaggctttgcatgttatttggcagcatccgactcgttatgcgcaagaacgagaacataatcaaatggttgatataggtactgacttagcggtcaaccaatacttaccaagagatttgggtgaactacctggtgcaatatcgtttcaaactattaatgaactctatcacgttaatttaccacacgatcaagattcatcgacctatatttctttattgtcagaagttgatcaaaaaaattcacgggcaaaaaagaaggctttgccaaaacatacggaatggcagagcgcgagtaattcaatagaagaagctgagtctgcacttaaaaatgtgataaaaaaagctaatgacgatacgaaatacgctgggcgtggtaatgtatcgggtgcggttttgcaacaaattagcgaggttgtcgtaccaaaacgtaactggaaaagtattttgcgatctggtatcagtcaagcaccaaataaaaagaaagattcacgagctaggtttaatcgccgacaggcttatcgacttgatctaccaggagaaattagtcgttatgatacggaaattgctgttttcattgataattctgcatcaatatctaattcacaggcaagtgagtttttagccaatgcaatgcagataacaaaacaatttgatattaacgtgcatttcttttcgtttgatacgaaggtgcatcaaattaaaaatataaaaacttggcagcgccatgccggtggtgggacaactttccaaagcatatttgatgcattgcccgctttaaaatttttccctttgcaaacactggtagtcatttttacggatggcgatggcgaaaaagagttgattcaaaccaaatttaaacatgtgtattgggtactaccagaggggcaaacattaagcataccatcaccatttggaaaggttattacgctatgaaattaaaacctcgagatcttaagagttttattgataaagacatacgctacaagcgggcagaagcattactgattgggcagtgggaatcattgttattaagtgatccgtgggacatgccgatgattacacgagccgatgtttcttttgcgaaaacattaagcgaagcaaatgttgttaaaacagatgttgatttgtcgacgtttaaaggtgtacagaaatttataagccacaacaacagtcgactatcaccagacgttgttaaactattaaaggagccatttttatgaaaataaacttagtattagcaccagagcagccagtttcggaactgttaacattacaaagtgctcaaccgcaaaatgtattttatttaggaaaaatttctcaactggcggggacaaatttactcatcattgatgctcagaatgtcgttgcaaaatttgcccgtcctattggatttgagagtcgagcagttatcggacaatttaaggggaatgttatccatcaaattgcttttcaggctaaagataacaatgatgaattgattgcaaagttattaactgggaatgccattatggctcaaaatgacaatggtaagtcagagtacatgatttggtcattctggtctactcacgatgaattggcacgttttctagctagtgaaatctatcaacaaatgcacgctttgatgaaaaatccgtatactacaacttatcagcacgtgactgatcaatcgcaattatccttgactaccaaaatgcgtgactttgacaaggagtggtggggataagtaattacgaaggctaattttcacatttttatcgtgtaaatcccgatatgttcttgacaatgtttttactggcctgtatgatattagatattaagaaattaggaggcaacacatcatgcaaaacatgaatcaaaaacaaaactcatctcaagccctccttctcctcctcatgctgtagtcatgatgaggtttttcgcactcatgactaactggaatcagtgttcatgggtgttgaagtgatgagtataactgctgtcattattaacgattagtaacccatgaattttggtattcatgggttttttgtttgcgaaaagaaggaattgagagaataaattggagaagaaagaatgaaaaaaattgtaattgtcggcgctgcgtttattgttgctattggtggtattgttgcatttggggtagtcaataagtctagcaaagcatcaacatcaaatgtgatcaaaattgggggtgtttttgatacatctggtgacgcttcctcatatggaaaagctgagcaagatggtgctaactttgctataaagcaaattaatgctaatggtggtgttaaagttaacggaaaaagctataagtttaaaatcattaacaaagatgctaagacggacaatactgaaactgcttcggtaacaagtagtttgattaacaaagaaaaagtcagtgctatcgttggtcccgtgattacctctggtgttcaagcagcagtgccagtggcaactcagggtaagacgccgatgatttcaccaactgctggtgcagacaacattactttgcaaaagaatgggaatgttcaaccttacgtattccgcgcacaatacaaaaattcttttatgggtacaaagatggcacaatttgccacagagactttaaaagctaaaaatattgtgattttccaggacaattcttccgattacggtactggtatcacatctgcatttaaaaaagcctttaagggtaacgtcgtagatgttgaatcttatcaagaagggacgaaagactttcaagcagttttgacaaaaattaaggataaaaagtttgacgcaattgcaatcaatggctattacactgagggtggcgcaattttgaagcaaatgcgtgatatggggattgatgtgccggttattggaccagatggcattggtgatcctaaaacggctgaaattgcaggaaataaaaatacaagcaatgtttattacgcggcacatttctcagttgatgcaccagctactaaggtttcagcaccattcgccaaagcttataaaaaggcttacggcaagtatccatcacaatttacagctttagcttatgattcagttcgcatgataaaagcagctattgaaaatgaaaatgcaactagcaaatcggcaattactaagggattggctaacttgaaaaattttgatggtgtaactggtaagatgtcaattgacaaagaccacaatcctgtcaaatcaatggttatggtcggtatgactgatggtaaagagtcatctgccgtagttgttaagtgaacacgttttctaagaaacgtatgaaactaatgcgtttgataatattttgaggttaaaatgactactttcattcagcaattaatcaatggtcttatgctaggcagtgtctatgcgctactagctttaggctatacaatggtctacggtattattaaattaatcaattttgcacatggtgatatatacatgctcggtgcgtattttggctattttttcatcaaggttttacatttgaatttctttatagcgttaattctcgcaatggcagtaagcgccattattggtgtggtcattgagtatgttgcctatcgaccattgcgtcattctccaagaattgcggttcttatctccgctttaggcatctcttttttgctagaaaatggcatgacttatttgtatgggtcagatcaacgttcatttccacaggcgattaagacagtacaataccacttttatggtatacaagtttcaaatattcagttgattattgctgtaacttcaatagttttgatgctgttattaacttacattgttaaaaatacaaaaatgggtcgtgcgatgcgggcagtatccgcagatccagatgcagcgtcattaatgggcatcaacatcaatcacacaatttcatttacatttgcaattgggtcagcattggcggcggctggtggcgttttgattggattatattataacagtattgacccattgatgggtatgactcctgggttgaaagcgtttgttgccgcggttttgggtggtataggcattattccaggggcagcagtaggtggttggctaatcggtatattggaaacaatggttcaagcgacagctttttcagattacaaagatgcgattgtgtatgcaatgttgattgtcatattgcttattaaaccgactggtattttagggaaaaacaagcgggagaaagtttgatggatcaagcgcatattaaatacacgttatcatgggcatctttggctgcaatggggttcattttgatattcgtggctcaaatggttggccttattggtcattatggcatcacaacgattgtacttatcggcattaatatcattgctgcactgggacttaatctagtggttggtatttcagggcagttttcgttagggcacgctggatttatggctatcggtgcttacgcgacagcattagttatggaagttgttccaggtatcattggctttattttgggaatggctgcaggcatcgtagtcagtggcgtaattgccttaattgttggtattccaactttgcgtttacgtggtgattatttggctattgcaacattagggtttgctgaaattattagaattgtcattatgaacttgaaaataactaacggaccagctggtatttttggcatcgcaccttttgtgagttggcaattagtttatatactagcagttataacattgattattgtggtcaactttgttcgtagtatgcctgggcgagccattattgccgttcgtgataatgaaattgctgccgaatccttaggaattaatacaactaagtataaggtaattgcttttgtgacaggggcattatttgctgctatggctggtagcttacgtgcaagtttcatccaatctattgcgcctaaagactatgcttttatgcaaagtattatgatcttaattattattgtgataggtgggattggctcaatgagtgggacagttgtgacagcaattgcgttaggtgtgttagacacaatgttacaaaattttggttccttgcgtatggtcatctacgctgttattttaattgctgtgatgctggttagacctcaaggtatttttggtagtcgagaactatcattaaagaaatggttatttgatgaaggagacggacatggctcagacaatactgaaaacgcgtgatttaagtatccgttttggaggtgtaactgctgttgatggtgttaatattgaagctgccgaaaatgagttaattggtttaattgggccaaatggtgcgggtaaaaccacattatttaatttactaacaggtgtatattcacctagtgagggagaagtactcctatttgatggtcagcagttagctaatgtcaatcgtcaatctcctgcaaaacgtgctcgattaggcgttgcgcgcacttttcaaaatattcgcttgtttgaaagtcgaacagtattagagaatgttatgattgctatgaattctagtactcaggcacatgtattcagttcattgtttcgtttaccttcattttataaaaatgaagagcaactaaaaaacgaagctcgtaagctgctaagtatttttgatatgctggaggtacaagatacgctggcaacaaacttaccatatgggcaacaacgacgtttagaaattgtgcgggcattggccacaaaacctaaaatcttatttttagatgagccagcagctggtatgaatccacaagaaacggctgatttaacacgtttaattaaacaagttcaacaagaatttaagatgacaattattttaattgagcatgatatgaaccttgttatggctgtcagtgagcgattatatgtattagagtacggtaagttattagccagtggcacaccattagaaatacagcaaaatgccgatgtgatccgtgcatatttgggagaaaataacgaatgagtgcattactgacagttgaaaatttaaacgtaagttatggtgccattaaagcggtacaagacgttaactttgtggtgaacaataacgaaatcgtatcactaattggtgctaatggcgctgggaaaactacaattttacgtacgatttcgggcttagaaaaacccactaagggacgtattttatttgaaaatcaaaacatattgactatgaattcagagcgaattgtctcaagtggagttgctcaagtgccagaaggacgtcgcgtgttttctggcatgactgttcaagaaaacctacagttgggtgcttttactcgaggcaagggtattaacttgaaagatgaatacacacttatttacgatcagtttccaattttaaaggaaagacgtaatcaagatgcagcgactttatctggtggtgaacaacaaatgctagccatgggtcgcgcattaatggcaaaaccaaaattgttattgttggatgaaccttccatgggcttggcaccgctatttattgagaaagtttttgatattattaaaaatgttaatgcacaaggaatgacagtattagtaatcgaacaaaatgcgaatcaagcgctaaaaattgcggatcgcggctatgttttggaaagtggaaagatcacgatgacaggtacgggagcagagctacttgcatcagatgacgtgcgcaaagcatacttaggcggttgattattcatatggattcaggtacactgaagtagaattaaataaatatctggggtgcccaagctggctgagagatacccattgaacctgattacggtaattcgtgcgaaggaagattataataatgaactattctagtgtataaatatgcctatttagccgttaactaatcttttctgatagttagcggtttttttattcattaatgttaatttttaaaattaatgaagatatttgtttaaaaacacgaagccaaacaaaaaaggaatttaatcatgaatattacagacattagaacgaaatcacctcttgtcctgacttatgcaaattttgttacaccacaatttgtagctaatgtagttaatgttgttggtgcctcaccgttaatgagtcgcgagctagcagaatttaaggaattagccggaattgccaatgcggtgattattaacacagggacgcttcaaaaagtagaaattaacgatattattaaactttctcaggaagcataccaattaggcaagacagtcgtattagatccggttgctgtatcagttccatttaggtctaaagccattacacaatttttagcctctggtcatgttgatgttattcgtggcaatgcagccgaaattgcttggtttgccgatattgattttgctagtcaaggtatcgatgctactggaaaaggtgacgtaattgaaattgcacagcgtgccgccaaaaaaacaggtgcagtgattgcgctaagcggggcttgtgacgttgtcagtgatggtcaatacacacaaacacttgatataaatgttgaacaattatcttctattgtaggtacaggagatgccttatcatcattaattggtgcgttcattgccgatgggctaaaggttcctaatgtgatgaatgcaatggctacattcaaacttgctggacaaaaagccgctacaaaaacgaatcaaccagggtcttttacaaatcaattattagatgaattatttgttattgataatatcgatgttcaaaattttattaaagaaagtgtgctgaatcatggttaataaaacaccccaagctctaacaattgctggtatggatagcagtggtggcgctggagttagcgcggatctaaagacgtttgccgcccaaggtgtttatggcgctaatgttattgttgctctaacagcacaaaacacaatgggtgtacagcaagtttcgatgacttcaccatctatgatccatgcccaattaaaatcagtggctgatgacttaaaaataagtgctgtaaaaagtggcatgcttggtgatgtgcccacagtagaatcagtgtctgaatttttacaacaagcagattttggtaactatgtattagatcctgtaatggttgccaagggaggcgctcacttattgagtgatgaggccatagttgctattaagtctagtttgataccgttggcaacgctcattacgcctaatatgccagaagctgaagtcttaagtgagtcaaacattactaaccatgaagatgtgatgcaatccgcttcaaagatacaacaattaggagttgaaaacgtattattaaaaggtgggcatgcctccgggaaagatgtttatgactatattctattggctgatggtagtcatttttggcttaaaagctcacgggtagatacaattagaactcacgggacaggggatacaatttctgcggccattactgctcgtttagctttgggagatgatatgaaaacggctattattcatgcaaaagcttatgttgatgctaccattcgtgaaggtatcgatgttgggcatgggcatggaccgcttaatcaccaggcaagagtgactgacaggcattttccagaggtactagaaaatgtttgatccgagcatattagtaaattattttgtattaggaactcaggacaccaatggagagagacatttttttgaagtcttagaggaagcactgcaatcgaaaatcagtgtgtttcaatatcgagaaaaagggcaactggctttaagtggatcagagaaattacgagtagccaaaaaagtccggcaactaacaactgactaccatgtaccattgattattgatgatgacattcaactagcacatgaaattgatgcagagggtgttcattttgggcaaaaagatggcgatattatcaataatattcaattagctgagaatctagctgttggggtatcggtgtctaatgacagccaatataaaagaatagagaatattaaagggattgattatatcggaattggtcctgtttttgcgacggtaagcaaagctgatgcaaatccagagattggggttgaaggtttaaaatatttgacaagcagaagtaaatggccaagtgtggcaattggtggaatatcggaaataaatttgtcatcagttttatctacgggtgttaacggtgctgctgtaatcagtatgattagtcaaagtgcaaatataagcgctaccttaaaatattggcgttcattacatttataaataatgtgttttgctgaaaatatcacaaacaaaatatactttgcgaatgaataatggtgttatagtaggggtgtttagaacagaaatgtaatttgttaattgaagaaaggtcgaataaaatgagctatcaaacaattaatccctttaacgacgaagttattcaaacatttgacaatcatgatgacgcttatgttgagaaggccattgccgaaggtcatgcactgtataaaaagtggcgcaatgacccggctagtagtcgcgcagagatattaaacaaaattgctgacttgatggaagaagatgctgatcatttagctaaggtacttactattgaaatgggtaagcgatttgtcgaggctcaaggtgaagtagcattaagtgtttcaattgctcgttactacgccaaaaatggtgcagatttccttaagccagaaccaatcaaatcctcgatgggggatgcgcaagtaatttcgcgccccactggtgtattgatgatggttgaaccatggaattttccttactatcaaattattcgtgtatttgcaccaaattatatagctggaaacccaatgcttttgaagcacgcaagcaatacgccaatggctgcatcagaatttgaaaaaattgttgaacgggctggtgcccctactggtgcgtttgctaatttattcattgattacgatcaagtgaataaaattattgctgacgatcgtgtacagggggtggcgttaactggttcagaacgtgctggacaattaattgctgccgaagctggtaaaaatatgaaacaaagttcgcttgaacttggtggaagtgatccattcattgttctggatgatgccgatttatctgagattaaaaagattatcgggggtgctcgtctatacaatgcaggacaggtatgtacttcgtctaaacggtttattgtaaccgaaaaaaattacgatgcggtacttacaatgttaaaagatgcctttgctgaagtaaagctaggcgacccattgttggaagatacgacattagcaccattaagtaccagcaaggctaagaaaaacttgaccaaacaagtgaaagcggcggttgatgccggtgctactcttgaatatggtagtgttgtccaagataaaccagctgcactgtttgatcccgttattttaactggtattacaaaagacaacccagcttattatcaagagttcttcggtccagttggacaagtttacaaagtgaaagatgaagaagaggcaattacactagctaatgattctaattatggcttatcgggcgtggtatttggtggttcacctgagcatgcgacggaagttgcttctcgtattgagacgggagcggtttatgtgaatagttttggtggaacattacctgagttaccatttggtggtgttaaaaattctggctatggacgtgagctaggacgctttggtatcgaaacctttgtgaacaaggaacttattgttaccaaaaaggaaccaattgatttagataatgcgtttggtggatttgtttaaaaattactaaatgccggttattactggttagacgattagatctcgaataatgctgagatttaatcgtttttcgttacttcaaattgagaacttggttggaaaggataaataatgaccagtatgcaaagaagttttacatgttttgtggatggtgaagaaaagaatgttgtcgatggtgtcttactggcagaactagatattgaactacaacaaaagataaagcatgattttcctgacagcatgttggcagattttatttgctttgatcatttgcttcaataccgtttagaaaaaatcgataaaatgatattggagaagcatagaacaaacaaacatattaataacaaactaacgcacatattgacagataaaagttttaaagttgtcaatgtgaataagcatcaaagagaatcctatacatttggccaaaaaatagcagataatgtcgcacattttggcggtagttggggatttattatcgtgtccatttgtgcaatgattatgtggatcatcaccaatgtttttcaattgttcaacatgcattttgatccctacccttttatattattaaacttatttttgagtatggtggccgcattacaagcgccgttaatactaatgagtcagaatcgatcatctgattatgacagattgcacgcagataatgattaccatgtgaatttaaagaccgaggaggagatgagggtactgcatgctaaaattgaccgtattattcaaaaagataaccccgatttatttgaaattcaaaaaatgcagacaaaaatgcttggagaattacaaaaacaggtcaatgagttacatagtcaccaaaaaattaaaaatgttgactaataaaaaggcctaggtgtgatacactttaggccttttgttctgtctatttttattttataaattgctcagaaagtgacaagaattcgtcaatatcttttttaaccaaatcggcaccagtctgccaaaatcccggcttcgttagatcaacaccaagatgcttttttgctaattcttctgaagtcatattagcagtgtcacgtagcaaggcaatatatttttcttcaaaattgtcaccatctttttgtgcttgcgcgtaaatgcttgatgagaataaataaccaaatgtataagggaaattataaaatggcacagaatcaatgaaaaagtgcagttttgatgaccagaagtggggatgacggacatctaaaataccatcaaaagcttctttttgcgcgttatccattagttgattgagacgctgtggtgtcactaggccatgcttacgttctgtgtaaaacgaatcttcaaataagaagcgggcatgtatgtttaaaaacatagcaataggattagtcatttttgcatctaataatacaattttctcggcatctgtttttgcttcttttacgttagcgtcattaacaatcaattcggcaaaagttgaggctgtttcggcaacgttcatagcataggcatcacgccaaaatggtaaatcagttagctgcgcagagtggaatgcgtgacccagttcatgcgcaattgtcgcagcatcatttactgaacctgtgtaggttagaaatattcgagactcgtgtaaatctgggacagattccatataaccacctggttgtttaccaggacggttctctgattcaatccaattattctcaaaagccttttgagcaaacgttgccatcttaggtgaaaacttaccaaattgttcgataataaatttagcagcgtcatcataagaaacatctgatggtttatagtcaccgatgttggttagtggcgcgacttgatcttgccaaccgatggatttcaaaccgagtaattgctttttacgttcaaaatatgttttaaacatactcttgttagcatctacaacttgccacatagcatccaaagttccgcgagacatacggttgagctccagtggctgttctaagtgtgattgacgaccatgagcttcttgattggttagacgaaatccagccaaatgatttaatgtatcactcgttaaattttcagcttttgcccacattttttcatagtttgtcatgaggttagcccgcacctcattatcgggttcaccatctaacatgttcaaagcttgtccagcggaaatttgacgagttttattgttttcatcggtatagctcatcgataatgaagcagatattgtgtcataatgctgggaccaagcttgctgtccatcaagatcaaatttgttaattaacgtttctgttttatcgtccaacaatcgtttagcatcagtacgcaactctgttaagtaaaaagcaattggtgcaagacggctagtagtgatagctttttcaaatgtttcatcatctaattttgaaagtagtttttgaaaagcatttaaaggagatgagaaagatacccataagtttcccaatttattaaaatgaggcgcataaacactgttaccataatctacagacgaccaaccattaacaaaaatattggcagtaccaattccagcaccaatattttgtgctaaatcagctaaatcagccaacaccgtgaaatctttgtcttgtgcgaggctgtaatcggctatcatatcagtaaaatcattgatttgctttgcgataagttcatatttttgagtgagttgtggtgaagttataccacccgggaatatactttctaaattccatttttgtgagtaggtcacgttaatatacctcgctttctttataatttatgataccattcttaatgaaattctagggataataatttattaaacttcaattttaatcataatttgtttgctccatgaccaaaattagcgtacaattttatggattgattataagggaaagtgatttatgaaaagaaagtataagtggttaattggttgtttggtttttattgctattttattgttatcagctggtatgtatttttttcatgttgctgaggtccgcgatgtagcagcagataagccagacaaattacgtgcaaaaacaaattcactttatcactacgaacatgattttttgtctcgtgaaaagcaaacatggacacaaaaaacatctgataatttgaaactaattgcttggtacgtacctgctgagaaaaaaacaggtaaaacagctatcctggctcacggctggcacaacaataaaacgacgatggccatatatggtgagttattccatgagttgggctacaacgtattaattccagataatcgtgcacacggtgattcacagggtgaaatgattggctacggttggttagatcggcgagactatatcggttggttgaatcaaattttagaaaataatggtcaaaaatcagatattgtcatgtatggtatgagcatgggtgctgctactgtgttgtcaacttctggtgaaaatgatttaccgaatcaggtgaaagcaattattgctgattcgtcctacacaagtgttatagaagagattaaacatgaagcaggagatatgtatggcttaccatggtttccacttgttaatgtggtttcgggtatctcgaaggtacgggccggatactcatatgaggaagctagtcctttgagacaagttgaaaaaaacacgcggccaacctttttcattcaaggtggggccgacacttttgtgccaaccaaaatggtttacccgctgtacaacgcttctagaggaccaaagcagttatggattaccaagggctcaaaacatgttcaaagttttcatgactacccagtcgcttatagaagtaaaataaaagcatttttggaaaaatatgataaataaaaggatcaactcattaatgagttgatccttttttggaacaaagttaatatcagaaacactacgaatcttctggattaaccccaaagatctcaatatgatatcctgtaatatttaaaccgctagctttacgtgctgcgtcaaacaaaggagccatatcgaaattatctgcatcaataatctcactagtttgttgattgatgatgtgataatgtggttcaccataataatcaaagtggcgcttgccatcatcatgaatgtctatagcgatgattaatccagtttcaattaatttatcaagcgtgttataaactgttgccaaactaatattatttaaatcttcgtgaatcatttctgctgtggggtgggttttatttgtagcgagatattctaaaacggccattcgttgatacgtagcttttaatccgtgttcttgcaatattgtacgcaatttttgatcagtcataagaatcctccatatttattactattatatcatgatatgtagaattgttccaaataacttgatttatgaaactagatgagttagaatgttcattagaatagttctaacaacaaggggaagttatgtctgaaaaatctgaaaaaacaagctttatgcagcgaaataatattattcgtgcagcagttatgggtgccaatgatggtattttatcagtatctggtatcgttttaggtgttgcaggtgctactagtcacacagatacaatcttactagcggggtttgctggtatgttagctggaactgtgtcgatggcaatgggggaatatgtttcggtcaattctcaacatgatgcacaagaaaaagtgcgtcaaattcaaactcgggctgttgcaaatgattacgatggcgaatttgaatttatacaaaaaaaatatgaagaaacaggtatatcatcaacgttagctcaacaagctacgcaggagatgatgtcaaaagatcccttggtcacatctgtccgcgaacgctatggattttctttaaaccaagaattaagtgctggccacgctgctttggcgtcattagttagtttccccataggatcaatattaccaatggttgctatttctatagcgcctcagggaacgcgagaaattgccacatttattgctgttattgtagcattagccattacaggatatgcagcagctcaagtaaatggtgcaaacaaaaagcattccgtaattcgtaatgtcattgccggtatctttacaatgattgtgacgttcttaatcggtagtttgtttagataaaaaaggggactgaaatggaaaaagtaaaaaaacacgaaaccatggatgaacgattaaatgccattcgagcaggggttctcggatctaatgatggcatactgacggttgttggggttttgttttcagtagcagcagcaacgacaaatcaatttgcaatttttattgctgggctagctgacttagtgtcatgtgctttatcaatggcttctggagaatacgcctctgtcagttcacagtcagatagcgaaaaggtggccgttgaaactgaaaaagaattgttaaaaactgatatgccagggcaacaccgttgtgtacgagacttttacatggaacgtggtgtgtctgaaaaaacagcaagtgcaatagctgatgagctgttgcagaaaaagcctttagaaacagtattaagtgttaagtatgatattacactaggacactatatgagtccatggtcagccgcttggtcatcattgttttctgcagctttaggtggtgcctttccattgttaacgttgttaattgtgtcaggaaagtatcaattcgttgccacaattgcagcaactgtagtagcagttgcacttactggatttcttagtgcgaaaatttctaatggcttagttaagcgtgcagtgattcgtaatattatcattggtcttattacgattgcaatccactttggcataggaaaaatattctaactagtataagttaacaatatctgttatatttttaattaatgttgctgaatacgggctatgtttgagataatagtattatgaataagaaaattatgcacaaatggcgtgttatagatgcacgattaaaaatatcaactttaactactttttttacacgctcacaaattggttatgttggaccgacatttgcttattatgcacttttaacagtctttcctatattgatgggggcagctttaattgtctctttcacgagcatcagtactgctgatttactagcaatgatgcgtaatgtattaccaaaaaatattgagaatattgtgattccaattatggaatccgttttatcatcaagaagtacttcgctactttctttttccgtcctgtttacgatttggtcgatttcacgtgtgattgcggtctttcgtcaatcatttaatgccattgcagacgttaaagaacacattaatagtttgttcacacgagctttttcatttatatggttgttgtttattttgacattatttgctttgttaatggttggtagcaatgttttgaccatcgtcattcagcacttgccgtattcagaatggactaactttttacaacatcaaacgcgttggtttatatggttgggtatttggctggctttggtcatgatgaatttttttctgccggcaaaagacgctcgagcaccatttcgttttgttttagttggcagttttcttgaattagtgatgttgaatctcttgaatagaggattcacgttttacgctcaatttgcattggggaaatatgatttttatcaatccgtgagttctatgattgctatgctgatttggttaaacttgattgctacaattttggtattaggttatgtagtcatcaaatggttatcggtcattaattggaggaaagaagatgtttcgaaacagtgattttgatatttttgaagacaaaacgttaaatggtcgaatggaaaaaataagaacgattattgatccaaagtttgaagagtttgcgtcgattgtgttgcctatattgaatacaaatgggcaagaatggtatgcacatgtagctaagcatttacgaagaacaacttatgcgccggataatacatgggtagcctttgcgccaaataagcgcggttataaaatgttaccacattttgaattaggcatttgggaagataatgtttatttttatcttgctgttgaagagaatatgaaacctgctcaaaccaacgtaatcactcaaaaattgcgtgaggtgagcccgttagtgagagaattaccagattcataccgattaagtcaagatcacatggtaaacaagacatactcattattacaatatgacgattcagtagaacgttatgaatctgttaagcatagtgaggtattgattggagtagaaataaaacgtggtgataaactttgggatggcgatggcattgtagataccttggttctagcaatgaaaaatttgttaccaatctacgaaaaaattaaataaaaataatggctagacttgaatattaagtctagccattatttttttaagaattcattgcttctatctggttaatttgttgtaactctagcgtttgggcttcatttatttcattgtatagtacggctgccagtgtattgggaataatgcctgtcgagctggcttgttgaatataattatattcaaattgaaatgcttgaatatataaatcactgttgatagttggcgtttcttgattatattcacgttttattaaattaaaataacgatcaaatctttgacgaacataactaatgtattggtggtcatcagcgtcattctctaaactattacgtaagagattatccaagtgctgattaacttcaccaatgacgtcgttatttaatagcagtaatccttcatgaatattttgccattgttgtgcactaccttgatgctctttggcccattttttacgaccctttagccgttgttttttcgtaatttggtcatttcggacgtgccactttatatgacgatatcttgcctttacatagtgaaaaaatctttgtagggggctgtgttggaaaaaactgctgattttgagacgattaagaattttttcatatgcatcaattacttcagaactgtatttttgttcaacactatcactgtggagataatgaataataaaatctttcgtgttgtttagcaaaatattatatttttgagaattataatttcttgttgaatggttgtcgtttaaccagcctttttgcgactgtaattgtatcataattgcctctcgaactgctgggtttgcagtagtctcagaaacctttaatgaggcatagtcaaccattttgttacgtgtgttttcaaggtcagccttggtataggtgaccgctttctttggtagggcgataggtaaaataattgcactcattaacatactaattaagataatcaaagtggcaactacaataagttcagcacgataagggaaagcatgattggcaatagttaacggtaaagaaaatgccatggctagcgtcatggtcccatgtacgccactgatggcgaatatatgggacaaaaaacgatgttgtttgggattgctgtggctgtcaaagaaagtgttagccgactggttgtcttcgcgaaatgcccaaatatatcgcacagcatacatagcaatataaattaagatgcttaaacctaatagttgcatgattccaactaagcccatatgaataatttcttgccaaacaatcggtaaagaaatacctaaaataatgaaaacaatactatttaagacattcgatattgattcccaaatagtgttggaagtcagttgtactcgtgtcgatgttaagcgaagcttattggattcccaattgtgcacaataccagtagcaaccacggctaagataccggaagtgccaaatgattctgctaaaaagtaaacaataaacggggttaagagactaatcgggatgatcgttgtttctgggctaacggttctgaaagtaatattggttcggatagtgacgagtaggaaaccagcaatcacaccaattagcgcaccaccaactgcaacaaacaagaagtgaccaatgcctgcgatgagagaaaattttccttgttcaagcacggatagggctaagtctaataaaactagtcctgttgcatcgttgaatagtgattctaattcaagagcctcgcccacaccattgggcatatcaactgacgaggtcattgatttgacggcaacagcatcggtaggcacaacaattgcagctagagcaattgctaatggtaatgtccactgtacttccacgcggttagctattaagccaacaacgattgcggtggccacagctaggactactgataggagaaagataattgaaaaacgtttttttattttagaaaatgattgtttttgtccatctagaaacattaacggtgcaataatcattagcataaaaaactcaggttcaagttcgaaattttgaaatatcggtgtaaatgataggaaaataccaacaataattaggatgaatggttccggaattttggggaagaattgtttaattaggttagtaccaatcacaccgattaacaataaagctaatgtatatagtgctgtcatatatcctccttaagaatgaagttttagtggttacaatagttctagtcaaagagattctctcatttggattgttgacgggattcgaattgttttggacaaagtggtttcatcattcataatctgcattaagttggctgcagccgttcgacctatttcttgggggttttgtgatacagaagtaatttcgggtgaaatcatgtcagcaaacatgtcatcatcataaccaattacaccaacatcatcaggtatagcaatatgatgtttctttaaaaatcgaacaatttcccacaagacttgtccattgagcgcatacagcgctttttttgtgggtgattcaagcatggattgtagtgtgttttgccagtccttattgtcatcaatttcgattagtttaatcgtaatacttgtgttctcaataccagtttttaggccattgtaacgattcatacggctagatacaccgttgatatgattggataaaacaataatttcttcgtaattttttgatttcattagatctgccacttctagtgatttttgaaaattatccgataccactgctggccaagtaaatggttcagtataacgatcaacttgaacaacggggatattttcatcaattaatagttggtagtgatcaggttggtgaaccaatggttgtaagataataccgtcgatcctttcggtgaccatcttttccaaattactatattcacgttcaattgaattgtcgccgtccataatcaaaacttgatagattgtattttgaaaataatcactgatgccttttaaaagacgcgaggtatacatattggaaatatctgctacagagataccgattaacagagagtttttggcttttaaggcttgtgcttggcgactaggatgataatctaattcagcaattgtttcagcaatacgttcttttgttgcttctgacatattatcaaatttcccgtttaaaaaacgggaaacagttgtctttgaaacccttgccatttcagctataacgttgatggtcacttttttactcatgagaacattatacgacaaattaaaaaaaggggttgacaaatatttggaagcgtttacaatatatcatgtaaaccggtttccgaaaacgatacacgtaataaaaataaagggatggaaaaatggaaaaagagcagttacatattgatccagaaaagtttgcgttacaatttcttgaatcttttaaactaaattttgatgctaaaaatcttgagggtatggctaaacaacaacttgcggcctatctatctgcttactttctagttgaaaaatttaataaaattgaaggcgaaaactttgatcggtcacaacctaatttatcagatttaggatttgacgagttattgaaacatgtaacagaactaaacaagtattgaggagcggataatgagaaaagaacaaattgttttaaataatttagtattcatgaatgatcatgagaagggaatgcaacaacttgaaatgttaaaaaaagctgtgtctttcggtgtctcatcggttgaattgcgacgggagtactttgatgacattgttaaagaaactccagccattgcacagtatgcagttgataacaagttgcggttattttattccgtaccagatgaggtatttgtgaaccatcgtcttaatccaaaattggcacaatactatgatgaagcacaggcgcttggcatttatgcgattaaatttaatattggagatttcgaaacgttatcttcggaagatgtgtctgaattaaaccaattattagcgcgcgacattcaaacaaatattgaaaatgatcaaacccaagtttcgggaaaaataaaagcgattgaaaagtttatgtctgctgttaccgaaaataatttagatattcgctatgtttatgatatgggtaattggcgttatgttggtgaagacgaagttgtggcagctgaaaaactaacacagtatgtacgctatattcatgttaaagatgatcaaggacacggtgataatttggtaaccgtaccgcttaatgaaggagatattgcatggcaatcaattttgaacatcttgccaagcaacgttcccgtagcggttgaatatccaacagttaatgacaaagttatacaagatggcgttcaggcactcgccatctttaattaaaggggtgtaagacttatgactaatataattattagtattttgctcttactaacattcgtaggctttatctattacattgttaagggtggcaatttagttattggtttctttgtaatggcgcttctctggtctgttattgggctggtacctttcgaccaagttgttcaaaaggttattgcagatccggcattgaattatggaccaacaattatttacattgtttttggttcttggtttggtcgtgtactagttgattctggtatagctggatccatttcggcgcagactgaaagagttggacgaaaagcgcctatttttgcaacgatattagttgtgctcgtcacagcattgattttctcgtcggcatacggcgttggttcggttatcgccattggtgttatattaattccaatcttgttgtcgattggggtccctaaaaaggtcgccattccagcattcacaatggctattggtgcgccaatgtacattaacgtagtcctatttaatcaaataaaagcgttctttccgtcagttagtttttcgggaaaatacttgatttttggattagcagccatgggggttcaattattaggcgttattatcttcatattgcttaatagtaaaagcatcaaaaatggtgaaattgaaacaattgatgacagtaaacaagcaaccttccagaaaacgcatccaattacatttatcatccctgttttaccggtggccttgaatatgttcttccattgggatgctattcctgctctgttattggcaactattattgcgttgttattgacagggcaaatgaaatcttataaaggattagttgcttttatcaacaaaacagtttcacaagcaatcaatgatatttctggtttgatcatattcttgatggcattggttatgtttgccggcgcagctactatgaacgttccccattttaaaagcatgattgaagttattttaccaagtagtccattggttttggcaattgccattggtatattagcaccattggctttgttccgcggacctttacatgtttggggtgccggagcggctacggcggcagttttagctgctacaggtactttccaaccaatatttttgctaccacttctttacacggcaagtattatggcagtttccattgatttaacacagtcatggaatacatgggcgctaacttactcaaagttggaaacaaaggaatacttaaaaatgggcataccagtgatgtgggtagtatcgtttgtgaacgaactattagtttatggcttttttggacattaaaaaggagttaggagaaacaagatgagtgaaattttaacattaggtgaaccggtagtgacgtttgcttccaccgacttaaataagggtttagttgatagtattaattactataaatttttgggtggtgctgaactaaatgtcatgatcggtgctactcgattaggtcataacacggaatacatttctcaggttggtgcagatccgttgggtcaatttacgattaaggaaatagcgcgttataatgttggtaatcattatattgctaaagatgaaggcaattggacggcgtttcagttaaaagaattagttgatcaaggagatccatcaacttttaattttcgcagaaattcagctgcggcacactttgacaaatcgttaattgatcaagttgatttttccgatgtaaagatagcccatttatcagggattttccccgcaatttcgcttcaagcacgtgaagcattccgttattttgctgaacaattaattgatcatggtattagaacaacatttgatccaaacttacgccctgctttatgggagtctagagaagtgatgattgaaacgatcaatgatttagcaaaatatggtgaaattgttttacctggtattgatgaaggtgaaatcctaattggatcaagagacccagagaccatcgccgatttttatctgaataatagtgaccgcacacaaactgtcgttgtcaaaattggttctgatggagcctatgtcaaaaacaagagcggtgagagttacattgttaatgggtttaaggttgaaaaggtcgttgatactgttggcgcaggggatggatttgcgcttggcttgattaccggtttgattgaaggattgaccatggcagatgctgtaagacgggggaacgctgtaggtgctctacaagttcaaacaccaggtgacaacgatgggtacccaacacaggaagaactagaagcatttttggcagataataagaaagaggcataatatgacaaaacaagtattcttaccagatgatattccagcagttgggaaaaagattcttgaagaagcaggattagaagtagttgttggttctggtcgtgatcatgaaaagatgaaggctgaaggggtagaggcaagtgctgtattgattggtacacaaaagtttgatgcagatataatggacgctatgccaaatttaaaggttattgcacgtaacggcgttggttatgatgctgttgacgtggatgctgcaacccagcgcggtatctatgttgtgaacacacctaaagctttatcaggatcagttgctgaaacggctgtctctgagttattagctatcagcaagaacttatatcaagattcaaaatcaattcatgatgataattggaattatcgaaaggcacacccaggccgtgatattgaagggaaaactgttggtatcttaggatttggtcgtattggtcagcaagttgctaaaaaattaagtgggtttgatgttaaggtcattgcctttgatccctttgccaaggatgtgcctggtgttgaattggttgatcgtgaaacgatttttaaaactgccgactatgtgatggtccatttgccggcattacctgagactcagcattcaattggcgcagatgagtttaagttaatgaaaaatgacgcatttctaattaatatggctcgtggttctattctggttgaatctgacttggtcttggctctgaaatcgggtgagatagctggtgcggctttagatgtttttgaagaagagccattgcctgttacaaacccattagttgcattggaaaatgttttgctcacaccacatattgcttctaatactgttgaaactaaggcgcgtatggcggttgatgcaaccaatgacattgttcgggtattatctggcaagaatccagaatcagctgtgaataaaattgataaataactagaaaaacgactgattaaaagtcgttttttaatttcaaggtgtataatgtagctattctaatagattacaggagaaaacatgactcaattcacacggctttataataattttcaacctgaacactatgatatctatttagatattaatcgtgagacgaaacagtttaatggtaaaacaaagattagtggtaatgcgctagtcaacaatattgccttacatcaaaaaaatttgcaaattcagtctgttcacattaatgaaaaagagattccttttgtcattgatgataacgctgatttgattaaaatttcgacagaaactattggtcagatagatatcactgtgacttataaggcgacgctaaccgacacaatgatggggatttatccttcgtattacgagctagatggtgttaaaaaacaaattatcggtacacaatttgaaacaagttttgctcgtcaagcttttccaagtgtggacgaaccggaagctaaagcgacatttgatttatcaatcaagtttgatgaacaagcaaatgaaacaattttagccaatatgccagagatacgcacagaaaatggcgtacattattttgatacaacagtgaggatgtcaacttatttagtggcctttgcctttggtgaattacaaagtaagcaaacggttactaacacaggggtaaaagttggtgtattttctaccaaggcacatgctcccaaagaattggattttgcactagacattgctaaacgatcgattgagtttttcgaagatttttatcagacaccttacccattaccacattcttggcaactagccttgcctgatttctctgcaggagcaatggaaaactggggattagtaacttatcgtgaagcttatgtattgcttgatcctgaaaattcagcgttgaataccaaacaaattgttgccacagttattgctcacgaattagcgcatcaatggtttggcgacttagtcacgatgaaatggtgggatgatttgtggctcaatgaaagctttgctaatatgatggagtatgtggcaattgatgccattgagcctgattggcacatttgggaaagcttccaaacaagtgatattgtttcagcattgaagagagatagcacagatggcgtacaatcagtccacactcaagtagaacacccagctgatattgatgctttatttgatccagcaattgtttatgccaaaggggcaagactgttggtgatggttcgttctttgattggggataaggccttacgtgaaggactaaaaagatactttgctcgtcatcgctatgcaaacgcagcaggagctgatttgtgggaggctttgggtgaagcttcaggtcaaaatattaaagcagtgatggattcttggttggaacaaccaggatatccagtggtttcagcaaaagttattgatggccagttaaccctatctcaagaacagtttttcattggtgaatacgaagaaagtgaccgtcagtggcaaatccccttaaacagtaactatgatgtggcacctcaaatactagccagtaagcgtgtagtggttggtgattatgctcaattacgtgaatcagttggtacaccttttaggctgaatgacggtaatgattcgcattttgttgttaaatatgatgcccaattactaaaagatattttagaacatcttgatgaattggataatatttcgcaaagacaaattcttcaggatctacatttactagttgatggtaggcaaattacctatgctgatatcgtgccactgctggtcaattttgcgcacaaagatgccatgttggttaatgcagtactatatagtattctttcagacttgaagaaatttgttacaccaaattcagctgaagaaaaagctttgaaggaattctatgatgtactaagtataaaacaagtaaaacgcttgggctgggccggtcaaagcggtgaatcatacgacaatcagctcacacgtccttatgttttgaatgcttctttgtatgcagaaaatcctgatacaattgcaacggctcatgaattatttgagaaaaacagtgataatctacaaaacctatctgctgatattcgtcactttgtactcgccaatgaattgaagcactttggcaatacgtcattgtttgaacaactgttaactacttaccgaaaatcctctgatgctaattataaagctgacttacgttcggccttaactagtaccccaaagccagatttaattgtaaaattgattgatcagctaaaggacgctgacacgattaaaccgcaagacctccgtggttgggtctatggcttgctagttaatgataaaagtcagcagttagtctgggattgggttcgtgagcagtggcagtggctagaagacacgatcggtggtgacatggaatttacgatgtatattactgttattgcgattgtgttccatacaccagagcgactagctgaatttaaggcgttctttgaacctaagttgaatacgcctggattaacacgggaaattactatggacattaaagtaatctcaagccgtgttgatttaatcgcagctgaaaaggatggtgtgaataaagccatttctgaggctataaaataaactagttaaaaagcaaacggttatatgtttgcttttttgatataaatcattttgtggtaatccttttgaattgctaattaataccgacttagagtagaatggggttgtattgaaagcgttttctattagaaaggggatcacgatgtattatagtaatggtaattatgaagcatttgcaacaccacgcaagccgaaggacgtagatcagaaatcagcatatattgtcggttcggggctagcaggattggctactgcagtatttcttattcgtgacggtcatatgaagggagagtcaattcatatatttgaagaactcccactggctggtggttcattggatggtattcaaagacctaatgttggttttgtcacacgtggcggccgtgaaatggaaaatcattttgagtgtttatgggatttatatcgctcagtgccatcattggaaatccctggggcctcttaccttgatgagtattattggctggataaggatgatcctaattcatcaaattgtcggttgatttacgatcgtggaaatcgtgtgccaaacgacggtgactatacgttaggtaaatcatctgaagaaattattaaattgattatgacgcctgaagcaaaattaggcacaacgacgattgaagattatttttcagaagactttttcaaaagcaatttttggatatattgggcaacaatgtttgcttttgaaaagtggcattcagcaatcgagatgagacgttatgcaatgcgcttcattcaccatattgatgggttaccggatttttctgcattgaagttcaataaatataatcaatatgattcgatggtcttgcctttgatcaagtatctcgaagatcatggtgttgacgtacagtttgattctacggttgataatgtcatggtgaattttgatcacggcaataaagttgtcaaggagttacagctcactgttgcagggaagccagaaactaaacagcttacagcaaatgatttagttttcataacgaacggttccattactgaaagtacgacctatgggagccattttgaaccagcgccagtgacaaacgaacccggtgggtcgtggcgtttgtgggaaaaattagctgaacaatcagacgaatttggtcatccaagtgtgttttatcaaaacttaccagcaaaaagttggtttgtttcagcaacagcaacaattaaaaatactgaaattgatccctatattgaacggcttaccaagagggatctgcatgacggtaaaatcaatacaggtggcattgtaaccattaccgattcaaactggttgatgagttttgctgtccatcgtcaaccacattttaagcaacaaaagcccaatgaaacaacagtttggatctacggactatattctgatgttcctggtaactatgttaagaagaccatcgtagagtcttctggtcaagaaattacacaagaatttttgtaccacctaggtgtccctaaaagtaaaattaatcaactagcacagcaagaatcaattaacactgttccagtgtacatgccgtttattacaagttattttatgccacgtgtcatgggtgatcgtccaaaagtaattccggatggctctgtcaatttggcatttattggaaactttgctgagtcaccttcgcgagatacagtctttactacggaatattcagtacggactgctatggaggctgtatatagcttgctagatgttgagcgtggtgtaccagaagtctttaattcaatctacgatattagagaattattgcgagctatgtactatatgaatgataaaaagccactgagcgaaatggatttgccaattcctaaactaatacaaaaagttggacttaagaaaattaaaggtacttggttagaagaattattggcagaagcacacttattataaactttgtcaggcactcgtccgcagatgagtgcttttgtcgtataatgagataaaaacaataaaaggtgtattatgattaatcaatatggtcgaattgctgttgattcagcaaccgaattagaagagctaagagctgttggttttaatagtgaagactttgaaacactattgcgacgtgctttgacaaattataaaacttatgaagcccaaaatgactggttacgggaacatctcgccaccgatgagcaaaatatttttcttttcttagaaacaaagcaaccactcacacaagccgtcttttattgtattgctgcccaactgctaggatttacggaggtcttggcgggtaacggatataatggggtggctacatttcggcaattaggtttaccaatagcgacggtaaataatttacgtcacgcatggtatgagttgctaaacagccacacaaataatggtttgttatttattgatgagctggcaagccaaggatattttgaatctaataatcatcgcctactctttaatggtaagtctttgccaacctataatacaaacgatttaatccgtgagtcggtttgggtggaaacttctgttgatactgataatgacgggcgatttgatttagtccaagtagatattataagaccaaatacaaatgaaaaattaccggttttatttacagcatcaccttattatcaaggtttaaacgaaaaaggaaacgacgccaaggttcatgacgttaacgtaccgttaacaagaaaggacacgcatcaatcagccctgagtaatttgaatcagatggaagagaatgtggcaaaaccgcttgcacgtcaaattaatggttacgctgaagaagcttctgtgatttttactcaagaagcagggaaaaccgttgatttgaatcagtattttttgtctcgtggctatgcagttgtttacgctgcaggtattggcacacgtcattctgatggtatgcaggatactggatctcccgagcaagttgaatcaatgaaaaatgttgttgaatggttagctggtaatagagtggcctttactgatcgcacaagtaatattgccattgtagctaattggtcaaatcacaatattgctatgacgggacgctcttatttgggaactttggctacggcagttgccaccacaggagtttctggtttaaaaacagttatttctgaggctgctatctctaattggtatcaatattacagagacaatggtctggttgtcgcacccggtggctttccaggtgaagatatggatgtattagccgaattagtatattcacggataaaagatccagctgactggttaaaaactaaaaaccagtgggatgattttcaagcgaatactgaaaagttcactgaccgtgtaaatggcaattatgactactactgggatacacgtaattatttaaatcaagtcaagaatattaaagtggatatgataatggttcatggtctaaacgattggaatgttaaaccacggcaagtttatcaattatggtcagcactccgcgatttaccaaacgttaaaaaaatatatttacaccaaggccaacatatctatatcaacaacaatcgctctttagatttctcagatcagatgaatctttggctgactgagaaattattggataaagatgtcaaagctaacgaagtattacctaccgttacatggcaagacaatactacagaagatgcctggcatgtcctagatgagtggggagcaagcaaaaaaagtaagtactatattggtagtaatgtgcttaccacccatcaaaacagcggtgaacttaattttaaggattggttacctgaaaatcagttcacttattactgcgagcattttgataaatggcgtgacgacacgattactggaaaattgccaacaaatcagatatttaagagcgaaacgtatacaagcgaacgtatagtagatggggaaattttattaaacctgcgagtaaaatcatcacataatataggattgatcagcgcaatggttgtcgactatggggatgacacatatctgaaagaaacacctactaaccaaggagtggtgattgaccgtggtgtgaattttagcccgacagatttgatgtcatttgaatcccaaaagtctgcttacaagatgatcactattggccatattaatttacagaaccggacgagttctcgtcaaaatgatgacttactgcctaatcaatatatcgatttacattttgagttacaaccaacctactacaaaatgagaccaggacatcaattgggattaattatatatgcgacagattttgaaatgacaattcgtggaaaccaatccatcgcgtacactatagatttatcaaaaagttcgctagatgtaccattcacttgtaaaaaataattataaaacatgaagttttatcttgtaattaagatggggcttcatgtttttaattgtaaccgtttacataattatcagattgtgttatccttaaggtagtaactagtacgtacaagttgtttgattaaaggagaaggctatgtttggatttgggaaaaaaataagcgaagatgagcatgtttacgcaccagtaaccggtgaagtaattcctttagacaaggtttcggatcctgtttttgcacagaaaatgatgggtgatggatatgcagtcgaacctaatgcttcaaaaattgtttccccggtttctgggaaggtgacgatggttcaaggtcatgctattggtttgaaacgctttgacgacctagagctgttagtgcatataggtatcgataccgtttctttaaatggcaaaccatttacaacggcagtgaaagaaggcgatattgttgatgcaggtgatgacctggtaacagtcaactgggagcaagtggaagaagctggtcttccaaaaacaacgctagtgttgattacaaatacagcagataaattagaatcaatcacagttcattatggaccagcagttgcaggacaacagttgggtagtgctaaggcaaggagagactaattatggctaaggaagactatgaaggcatggctcaagacatcattaaaaatgtgggcggtaaggacaatgttgataaagtgatacattgtattacacgcttgcgtttctatttaaatgatgaaactaaggccaatacagaagaaatgtcaaaagtaccaggaatagctggtgccgtctataacagcgcgttgggacagtatcaagtagttatcggaccagcagttgctgacgtctacgataaggttgtcgagcatctaggatcaagtgtagtggacaacgaagcaacgaatgcagcagtagaagcaacaaaagccaaagatcaaaagccaaaaaatgtacttgactggtttaaaggtgctttccaaacgctaattggtacaatcactggatcaatgattccggtgattggattattagcagcaggtggtatgttaaatggatttctgactttattgtcagatccaaatttgcttggtttaattagtaccaagtcagatacgtttacgattattcagtcgatggcgatggcaccattttactttttaccagtgttagtcggatttacagcagcgcagcagttgaaatcagatcctttggttgtggcggcgattggtgcgctgttagttaaaccagaaatgattgggttatcagcagcaaaggcttcaggtgtgttgttaggtatgccaatcaacgcacatttctttggtttaccaattacaattcctaactatgcttattcaattttcccaattatttttgcagcttggttggcacgtcccattgggaattggctaaaggaccatttgccagcttcaattcgatcaatcttccaacctttaatcactatctttattgttggttctgttgtattagtaatcatgggacccgcaattacaatgatttcatccggtatatctgttgctattaatgcgttgcttaactttaactacgcattatctggtttggttatcggaggtttgtatcaagtattagttattttcggattgcattggatggttgtgccgctaattgctaacgaaattgcgcaaacagggcagtcacaattgaatgcgctggttaacttcacaatgattgcacaaggtgctggtgcattagcagtctttgcaaaaactaagattgctaacttgaaaggtttggccggtgctggtgcgttgtcagcctttgctggaattactgagcctgcgatgtatggtattaatttgaaatatggtcgagtgttctggatggctaacttaggtggtgccacaggtggtttgattgccggactattcaatcttcatatgtatggtttcaccggctcattaattggtttcccatcatttgcttctccacaagataatcctaataacttattgattttcgttatcgcctcagcagcaacaattgccgtttcgtttgtagcagtttatctatggggatttaaagacagcgacacggaacaagcagccgcacaagttgaaaagaagaatgtcttcaaagatgccatttcaaagtgagggatagaagattatgactgaattaggaaaacatgttgtttaccaggtttatcccaaatcgtttcaagacagtaatggggatggtgtaggtgatttgcctggtatcattcaaaggctgccctacttggcaaagctgggagttaccatgatatggttgaacccagtgtttccatccccacaaaatgataatggctatgacataagtaattatacggcgattgatccattatttggtacgatgactgattttgagaacttggtcaaagaagctaaaacataccatatgggaattatgttggatatggtattcaatcacacctcaactgatcatacttggttccaaaaagcgcttgcaggtgatcaaaagtatcaagattattattacttgcgaccttaccgtgataatggacatgagccaactaattgggtatcgaagtttggtggttcggcgtgggctaaatttggtgatactaatttagcctaccttcacttatatgatccaacacaagctgatttaaattggcataatccagcagttcgtcaagagctctatgatgttttaaatttttggttagcaaagggggttcgtggtttccgatttgatgtgattaatgtaatcggtaaatctgaagtactagttgatgatgaaactgataacggcggaaagtttttatatactgatacaccaatcgtccaagactatatacaggagatgaacgcagctacttttgggaaatatcctgatgtaattactgtaggtgaattaagttcaactactgtgcaaaatacagctgcatatacaaatcctgataacaaggcgttaagcatggggttcaactttcatcatctaaaagttgattatgatcatggtaacaagtggacaaaagtgccttatgattttgaatcattgcgtcatatttggcatgagtggagtcaaggattaatggagaatcacggttggccagcttggttctggaacaatcacgatcaaccacgggcaataaaccgtttcattaaaacaccaaaatattatcgtgtcggtgccaaaatgttggctatgcttgttcatttaaaccgaggcacaccatatgtgtatatgggcgaagaaattggcatgattgatccaacgtatcataaaattgaaacatatgttgatgttgaaagtaaaaatgcttatcaaatgctattggagcaggggttgtcgaaacaacaagcttttgaaattgttcaaacaaaatcacgcgataactcacgtgttccaatgcaatggcgcaatgaggattatgctggtttttcaacgcatgagccatggctacaaaatgcgaattacgaacaaattaatgttgctcaagatgaaaaatcagctgacagtttgtatgcattttaccaaaatttgattcgtttacgtcaagaaaatgaagtgattgctgatggtgactatacaccaaagtatgaggaatctgaagaaatcattgcctttgaacgacaattagcaggaaaacatattttggttgttacacattttggtgaaacgccagtgtcaatatctatttctgatgagattgttaaaaatggtcaagtgttggttactaactatccagcgcaacctgtttcggggacaatgcttttgaaaccctatgaaagttttgcaattgcttactaaataaaaaacaactgctcaagtacttagtatttgagcagttgttttaagttgtttgtcgtcgtgcaaattcattaaactgaaattgatcaggtctatgtcttgcaatagtgcgttgaaaatatgttgtgtcagttaagtgaccttggctttcaacttggattaatcgattttcgttctcaggcaaaccgaccaataatttgcgatccattgctgtaactagttcggcagtaattgttttttcagcataggcaaccgacaagtgtagggtattctcaatataagcataaatagaatgcttagctatgtctttagtgaggccaggaacaatgtctgcacggatataatcttcgtcaataacactatagataccgtcgataatgcgaacacgaacaatatgatataaaggggtgccaacaggaaataaagttgttttctgagtcttttttgtgacggtaagatgttcgaatacaggaacctcagtaacaacatggaagtgttgcagctcttccaattcatgaaaactggtgagcccactgattggaaagtgacgtaactgatgagaaatgacttgtgaccctttaccacgctgtttttgaataagtccttcttcgtctaattttgcgagcgctttacggattgtatcgcgagatgtttgaaattgagtcaccaactcattttcgctgggtagaaaagaaccagcggggtaagtatggtcacgaatgtcatctttaatctgctgatatattttaaagtataatggaatcatgttgaacctttaggattctggatttggtgtagttaatgcattgttacgaataaaactacggaattttttgaacgtatctgcgaataactcgtctggttcaatattgagcatttcctttggaaaaaagaagcgctgatctatggaggccttacctttaatagctgcaactaatgtggacatatctgataattcacgatgtgaaccatcggctaacaaaaagtcaatttgtgtccttggcttggcgacatttggtttgtaatcatcataaggcaaatcataggcattattacgcgccgtgtaaaatctaggattaaatccagcattatccacaagttgctcgagttcttcaagcagtggggccgtttcgtcggtgatttccattgattttagtgggcgacgtcccatgaaacgttgtgataaatcagacaaaatgggatcagaatgtgattgccaaatattaatataggtcataaaaacattatcatcgagctttaaatattcagataaagttagttttttgtcgctaaataaaggcgctaatagcggaccaacaaaatcattttccgcaaactcgctagtcgtattagagcgatacagttcttgtgcgcgttgtagtaaatgttctagcaagacttccatgccacgagatactgggtggaagtaaacttgtaaatacatttgataacgtgaaacaatataatcctcaacggcatgcataccagcaatgtcaaaggcaatgccatcaggggttggttgcatagtacgtaatattcgatcaatatcgaattcaccatattttgtaccagtaaaataggcatcacgtagcaaataatccattcggtcaacatcaatttgactagaaattagttgaacgacttgtggattttcataagttttcgcgataacactggcaactttgtttggaaagtctggtgaaacttgagccaagacgcggtggatttctgtatcacccgtaataatctcacgagtcatcgcctcgtgatctgtatgaaataagtgttcaaaggtatgcgagaaggcgccatgaccaatgtcatgaagcagtgcggctactagcgttagtaggcgttctttcgggtcccaaacatcactgtaatactgttcaaagcgttccgtgatacgacgagcaagttcatagacgccgactgaatggccaaagcgagaatgttctgctccatgaaaaacagaacttgttatacctaattgttttacacggcgcaacctttgaaattcaggtgtattaatgagatctaaaataataggatcttcaacatgtatgaagttatggattggatcacgcagtactttttctttaggtaatttttcttttaacatagtaagcccttttgccgtttcttatattataatagattttagattaaaataggggtaaattatggcaattaaagaccaaatagatgttgaaattcatctaaaaacgaaaattcgtcaagaaaatgatcttgaagaattcgaatttcatacaaatggacaactttttttgaaaaacgatgcactttatttacgatatacagaagtaattgagaatcaaaaaacacaaattatgtttaagtttgaagagaaccgtgtacgtatgaatcgatcaggtgacattttaacaaagttctcttttgttaaatcacagcgtatccctgccttgtatcaaacaccaactgggcagatgcagttggaaacactaaccacattaatggcgctaaacatagatcatgaagaaacgcatggtgaagttgcgattgactatgttctttatgctatgcaacaaattgttgggcaatatgaaattcggttgcaatttatgcccaaatctagtatgctagattagttagaaacccccgaaaggacgtagaacatgtcacttacaacattaggcaatcaccctaaagaagaatttgcattggttgaaattgcaacagccattttgacagaacataaagaagcgatgccttttagttcattagttcaagaaatccaggaatttttggaagttgatgcagagacgtttaaatcacgtctttcacaattttatacagatttgaacactgacggttcattcatttcacttggaaataatgaatgggctttgcgtgcgtggtatccagttgatgcaatcgacgaatctatccatgagcttgacgatgaagaagacgctcctaagcgtaagaagtcagcaaaaaagaaggttaacgtatttgctgataatgcttcagatgatgatgttattgattataatgacgatgatcctgaagacgaagactttggtgcggttactgatgatgatacagagactgacgacgaagaaactgaagttgaagttgaaagcgatgatgagagtaatgaaatcgatttatcagatgatgaatcaattgatgccaatatgacagagttatctggtggcgatgatcttgatgatctgagcgatggcgaccaagaaaaataatctagaatgaaaactacctgctgggtagtttttttctataatactaacaaaaaaattttaatttttgtaagtgacaacggctatttgaatgccttttcagttaaatgataaacgccaatcaaaaaaagtaatttaaattgaaaaaaagggttgctttttgtttggaaagtctgtattatatataaatgtgctaaggcataagaaatgctcctgtaactcagttggttagagtaggggatttttaatcccaaggtcctcggttcgaatccgagcgggagcactgacgtaaagttggcgacctttgggataatccatttaaaaagaattgttcgttcagaacagttctttttttgtatatcaattaggatatataggggggaatgtgttttaaatactggttaaaattgactttgcaaaataagccaatatagtgtattataggtaaaaacgttgaagaggaagagtactaatagttgttgtttgagagacgtcatggctggtgaaaatgacgcaatgctgtttggaaaactaccttggaagtgacatacgagtagcacgagtgaaagtatgaccggagtcattggtcgttaacctgatgaaagagttaagatgaagcgcagctaataaggaattaattatttttgcttaagctttatcttgaactattcatgaggtggtaccgtgcaaaaagcgcccttagatttaagattctaaggacgctttttttattcgttttaaagaaaaggaaactgtcatggcagagaaacagaatagagaactaagcagagatttatcatctcgacagatgcaaatgattgcgcttggcggcacaattggtgttggcctgtttatgggatcatcagccacaatcaaatggactggtgtgtcggtattattagcctacgcgatagcgggattggttttgtacctagtgatgcgtgctttaggtgaaatgctttatgtcgatccgtcagttgggtcatttgctaattatgcaacaaaatatattcatccggttgctggatatttgaccgtttgggcaaatgttttccaatggctcacggttggtgtcagtgagacgattgctgtcggaatgtatttagattattggttcccgcacattcctggttgggtcactggggtggtagtattggctatgctaacagccgcgaacctagtgactgttaaagcatatggtgaaatggaaacatggttttcgttgattaaagtggttactatcatatttatgattattttaggcttgttggttattgtgttgggttttggtaatcattggcaaccgattggtttttcaaacctttggacgcatggaccgttctttgctggtggtgttaaaggatttttctttgcactgtcaatagttatcacatcataccaggcgattgagataattggtataactgctggagaagcggataatccacaagtagctattgtaaaatcaattaaatcaattgtggcgcgtatattgattttttacattggtgccatatttgttatcattactatttatccttggaacgaattagatcaagtcggttccccattcgtcgaaacattttcacgagtaggtatcacagctgctgctggaattatcaattttgtgatgatgacagcagctatgtcagctttgaactcaggaatcttttcgtctagtcggatgctttacacattggcaattggcaaagagctctcaccaaaatttttgaaattatcaaagcaccgtgtacccacattaccagtactagcaatttcaggtggtatcctactagggattattttaaacgccgtattacctttattttggcacggtagttcaagtattttcgtattagtttattcagcaagtacattaccaggcatggtaccttggtttgttatcttgtggagccagataaagtttagaaaagaaaatgctagtcaaatggtgaatcatccttttaaaatgccattcgcaccatatactaactattttgcgattttaatgttattggtaacactagtatttatggtatttaatccagatacacgagtgccgttgtttataggccttggattcttagtgatcatgtcaattgtattttttgcaacaagaaagagtcaccgacgaaatagtgaagtaagttcatcgaaaacgctttgagcgttttttatttgctgtaaacttgacaacagcattttagtaaactaaaataattaacatggtttactaaaggagaatattatgaaaacaaaagccctttcggcttcggctattttattagcagtaattattgtaatgggcgctattccagggattccattaggattcataccggccccaattattttgcaaaatatgggtattatgttggcgggtgttattcttggaaaaaaatacggattcttcacagttcttgggttcttgattctagcagcccttggattacctattttaagcggtggttcgggcggatttgttgtgttcattggaccaacagcagggtatttattttcttatccagttgctgcatttttaattggttgggcaacagaatggttagagaagaacaacaagcttagttttttaacacttttgataacattactcatttttggaatgttgttcattcttgtatctggtgcgattggattaaatatagtggcacacatgtcattaaataaagcgttgatttatcaagcagccttcttgccgggagatactatcaaagctgtcttggcaagtattattggcattatcttgcataaaagacgtttgacattgtgattaaaggaataaatttagatcaacaaggccgttgcaagcattggcatacggatgtcgatgtggtggctaatcgttgcgctaaatgtcgaaaatactatgcttgttacttatgtcatgatgcattaaatacgcatccattcgtgccagtttctctagatactgaagagacggccgtctgctgtggcgtttgtttgcatcaaatgacacccgcacaatatctacatgctcactatcagtgtcccaagtgccatcatttgtttaacgcgcaatgtgcattgcacaaaaatacctatttctgctaaactaaaactatgaaaacaactgatcagcttttaaaatactttctgaaacacgaaggtgaatatttaagtggcgagacgttagctaatcgattaggtgtgagccgcgcggctatttggaaagcagttcagaaactaaatgaagacggccatcaaatcgatagtcaacatagaaaaggctatcgctatgaagaaacaggcgttttgagcgtaccagctattaaggcgctgattgccactaattgggacattcaggtatttgatcaattagattcatcaaattcatatgctaaggaagccctagcggctgggaagatagttcacccaactgttatcattgccgatcaacaaaatgccgcatacggccgctttagacgctctttcgttgcaccggaaaaaacagggttgtatttatccattgcgttaccggtgatgaatgatagggtgttagagccaggactactgaccaccgctacagcagtaattgttcgacacgttattgcatcatctttaggatatcaactctcctttaaatgggttaatgacttaatctttaatgataagaaagttggcggtattttaacagaaggtgttctcgacatagagtcgcaaagtttgacatctttggttgtcggtatcggtttaaatttaattcaacccacaaatttacctgatcagttggataaaaaagttggtggcatcgtttcggatttagttttttcacgaaacatgatgattgcaaagttggttgatgaatttgctgacatgattaatcaatatcagacaggaaagtatttgcctgaatatagggcgcacaatattgtcttgggacacgaagttgtagttcaatatgctggtcaaaaaattcatggaaaagcggttgaaataagcgatcaaggtgcattaattttagtgacatccgctggcgaaaatatcacaatatcctcaggcgaaattaccaaactcaatgttaatggtaaggaatattgactgagcaccttttcctcaacccaaagttaaaaataatttcaatatttatttgacaaatctacagcaactctgtaatatatattagggctcccgttaatgggacagacgttaaaagctcccaagttgatcttgggggcttttctattttatttttacccctagttgtcgcaataaaacgtgttaagccaatgcgcgtttgaattatgaggaggcattatggcagataaacaagtgaagtatatttttgttaccggtggtgttgtttcatctcttggtaaaggaatagttgcagcatcattaggtcgattgctcaaaaaccgtggattgaaattagctattcaaaaattagatccatacattaatattgatcccggtacaatgtcaccatatcaacacggggaaacatttgttactggcgatggtttagaaactgatttggatatggggcactatgagcgtttcatggatattaatacaaacatgtattctaacgtgacaacagggcgtatttattctgaggttttggcaaaggaacgtcgtggtgattataatggtggtactgtacaagtgattcctcatatcacaaatgccattaaagaaaaaatgcaaaaagctgctgaatcaactgatgccgatgtcgtgattgttgaagttggtggaacagttggtgatattgaaagtttgccatttgtagaagcattacgccaaatgaagtcggatttgggtagtgaaaatgttttctatattcatactagtttgattatttacttagctgcggctggtgaagccaagacaaagccaacacaacattctgtagcacaattacgttcgttaggtattcaacctgacatgattgtcttgcgtacacaacgtcctctagaagagaatttgaagcaaaagatatcaacatttaccgatgttaatgaaaatgcagttattgaatctcgtgatgtagaaactctttatgagattccgttaaatctgcaagcacagggcatggatgatgttgtattaaataagttaaagcttgatgcgccaaaggcagaaatgtctgattggtcaaagatggttgaattaattaagcatcctaagaagacagttaacgtgactttggttggtaaatatactgatttgcctgatgcttatatctctgttaacgaagccttgaagcatgcaggttatgcccaagatgccgatgtcaagattaatcatgtgaaatcagaaaatgttacaccagagaacgttgctgaattgttagcaggtgctgatggtgtgattgtacctggtggatttggtgaacgtggtactgaaggtaagattcaagccattcgttatgcgcgtgaaaacaatattcctttcttaggcatttgcttgggtatgcaactagcatcaatcgaatttgctcgtcatgttttaggttataaggacgcgaattcgacagaattaaatcctaatacttcagcgccaattattgatttgatgaaagatcaagctaacgtcgaaaacctaggtggtacgctacgtctgggattatatccagcaatgctattacctggcacattgacagccaaggcttatgggaatcaatcagaaatcgaacaacgtcatcgtcatcgttatgaattcaatacacaatatcgtgaagaatttgaaaaggcgggtatgttattctcagcaacatcccctgataaccgtttgatggaagttattgagtatcctaagaatgatttctttatcgcagcgcaatatcatccagaatttttgtcaaggccagatcgtcccgaaggcttgtatcatgacttcgtggctgcctcaattaaaaatagttgattcatagcattttttagttagataaaatatccctttaacacttttcgtgtaaatggggtattttttaattaagattttgggagctgacaaacttgacagacaaggtataatgaaaacatgttagcaaatacaacacaacatatcgaacaaaaattaattttattacccagtgagcctggttcatatcagatgaaagaccagaatggcaaaattatttatgttggtaaggcaaaaaatctaaaaaatcgtgttcgttcatactttaagcaagatcatgacggaaagacagccgaattagtatccaaaatagttgattttgatttcatcgtgacaaattctgataaagaagcttttttgttagaaaacgaattgatcaagaagtataaaccatactacaatattcgtttgaagtatggtacaggatatccttatatcaagattacaaaagaacgtaatccaaaaatggctttagtcaatgaggtaaaaaaagacggtggtttttattttggaccatacccaaacgtctatgctgcccaagaaacgctaaggtttctagagaagaactatccattgcgccgctgtaacggaccacaaggtagaccgtgcttgtactataatatgggtcaatgtctgggcgcttgtttccgtgatgttcctgttcaagaatacaatgatcagatcagccgcatcaaaaagtttcttgatggtgatacaaagattgtcaagaaacaaatagctgaaaaaatgcaagttgcagcatcgtcattggaattcgaacgggctgcagatttacgtgatcagttaaagtatatcgacgaaactgttgagagccaacgtgtgctatcaaaagacactacaccaagagacctattcaattattatatggataagggctggatgaccgttgaggtattctttctacggcaagcccgtttgattcgtcaatttaagcgaacgttttccattgttggtgaggctgatgaagaagtttccagttttattcagcaattttattcgcaaaaaaacattcaaaagccacgcgaagttctggtaccaaaaggtattgatacaaaagcactttctgctgttctagaggttccagttagaattcctgtgcgtggtgaaaaacgggagttacttgatttagctgctaaaaatgctcgtattgtgttagaggaaaaattccgactaatgcaattgaatgagcgaaaaacgactggggcaatgaaggaaattactgatgcacttcaaatacctatgggtcatcgaattgaagcattcgatcactctcatacacaaggagttgagattgtcagtgccatggttgtttttgacgatgggatccctaataaaacagagtaccgtaaatataaaattaaatcgacagatcatgcaaatgaatgggcagaaacgcaagaggttattcgtcgcagatattctcgtctattaagggaagacggcgattttcctgatttaattttaatggatggcggcgaaattcaattgcatgcggcgcaagaagtgttagaggatgagcttgggttaacaaatataccaattgccgcaatggttaaaaatgataagcataagacggctgatctaatcgatggtgtgactaatcagatagttactcttgacaaacagtcagagggtttctttttaatacaacgcgtacaagaagaggtacaccgatttgctattagttttcatcgtcagttacgttcaaaaaactcacttgcttcacgtttagacacgatacaaggtgttggtccgaaaacaagacaaaagcttttgcgagagtttgggtcgttacccaaaattaccgcagcaagtgttagcgacttagttgacattggtattaatgaaaaattagcacgtgtgattcatttgtcgctctcggcaggtgataatagctaagatggcttatatatgttaaactagagtgttaattattcgcaagctcttcgttgtagagcagtaaaggagaaaaggcgccgcaggatagtcagctaaacgattaagttaaatgttaattttttggtttacaagcaaagaatatatctgctcgcgctctatatagatatggcattcgtagatcaagcacaaatagaagtaaaggccggaaaaggcggtgacggtattgtttcattccgtcatgaaaaattcgtagcaatgggtggaccttttggtggtgatggtggtcatggtggctcaatcatctttaaagtagatgaaggcctgcgcacactaatggattttcgttataatcggcattttaaagctcaaccaggtggcaatggtggcacgaaagggatgaccggtgcttcagctgataaccgtgtcgttaaggtgccacaaggtaccaccgttagcgacgctgatacaggtgaagtattggctgacatgcttgaaaacggccaagaacttgtggtcgctaaaggcggacgtggcggacgtggaaatattcattttgctacgccagcaaacccagcgccagaattgtcagaaaacggtgaacctggccaaattaggaatctaaagctagagcttaaggtactggctgatgttggtttagttggatttccttctgccggtaaatcaacgctcctgtcagttgtttcaaatgctaaaccaaaagtagcggcttatcattttacaacattatcaccaaacattggtatggttcgtctagacgacgatcgtgattttgttatggctgacttaccaggattaattgaaggggcttctcaaggtatcgggctagggttccaattcttacgtcatgtggaacgaactaaagttattctgcatctagttgacatgtcaggtattgagggaacagatccctacacacaatatcgtaaaatactagatgagctacaacaatatgatgaaacgattttaaaccggccacaaattgttgtaccaactaagatggacatgcctgactctgaagaaaatcttgccaagtttaggaaagaagttgctactgattctgggttacccatccaaccagaaattgtaccaatatcatcaatcacacgtgatggtgtcaaggacttaatgcgtttaacagcagatatgttagctacagcacctgcgcctgaaagttatcgaccagagaccaaaaatgatacatctgaaaagagctacacgttcaaaccggaaacacatgatttcacagtcgagtggattgcggatgaagaacgttggttgcttagcggtgctgaaatcgagaagttattcttaatgactaatattcagcgtgacgcaacaattatgcgatttgctcgtcaactacgtcatatgggcgttgatgataaacttcgtgaagctggagctaaagatggtgacgatgttcgcatcaataattccgacttcgtatttgaatttagtgaataaaatattctcaaaaaggtttgtcaacaagacgaacctttttttataatttttaaagagcaatatctgttcttgtgaaaataataccttgttgtataagcgatcttcacaattttaaggctactcaaatttaatcaagagtgctatgatgaaaatactaagataaggtgaggcaaatgaatcatggcaaataaaaaatatggtgcagatattgttaccgatagtttagtcaatcatggtgttgatttagtttttggaattccaggtgctaaaattgatcgtttattcgaaacattagaacatccagccgaaggtcaaagagtacctaaattagttgttgcacgtcacgaacaaaatgcagcttttatggcacaagcatttgctcgtataacaggaaaaacaggtgttgttattgccacctcaggtcctggtgtcggcaacttagctactggattaatgacagcaaccgctgaaagcgatcctattgtagccattggtggtcaagtaccgagaaatgatttatatcgtttgactcatcaatcaacaaattcagttgcattgtttagtccgatcacaaacctcgcttcagaaattcaagatccaaataatatttcagaaattatcgctaatgcttttgcagccgctaatggcgctaaaaaaggtgcgacttttgtttcattgccacaagatgtagacgatgcacaagtaactattgaagcacttcctaaaattacccctgcacagcaaggcgcagccgctattaaggatattgattggttagctgaacaaattaaggctgcaaaattaccggtgttgcttgtgggatcacgtggatctgatgatgctaccgttactgcactacaccaattactgaaacaaacaactttgccagtcgttgaaactttccaaggcgctggtgtaatttcacgcgaattagaaccggaaacatttttcggccgtattggcctattccgtaatcaaactggcgacaaactgctaaagcaatctgatttagtgattacactgggttatgacgcgattgaatatgagccacgtaactggaacaaagaaaacaatctgaacattgtcgctttggatacaacaccggttcaaattgataataattttgtaccgcaacggcagttggtcggggacttagcacagagcctacgtttgttgatagaacgtcttaatggatatgaattgccaaccactagcaaagaagtgctaaaaaaattgaaagcagatctacgagcatctgacgaaccttcttataccccagcacaaggaaatttgaaccatccgttggatgttattaagtcgattcaagcccatgtgacagatgacatgacagtatcaacagacatcggttcacactatatttggatggcacgtcatttcaagtcttatgttgcgcgtcactaccttatctctaatggcatgcaaacacttggggtagggttaccttgggctttagcggcagcaatggttcgtcctaatgccaaatcggtatcagtatctggtgatggtggtttcttcttctcagcgatggaattagaaacagcagtacgtttaggattaaatacagtccacatcgtttggaatgataatgcatattacgatatggtcaagttccaagaggaaatgaaatacaacggccagtcagcaggggttaagtttggtaacattgatttggttaagtatgctgaaagttttggggccaaaggcttacacgttgaaacaccagatgaccttgatactgtgctagacgaggcattttcaacacaaggacctgttgttgttgatattccggtagattattcacataactatgagcttggttcacaattgattggttctgaaggataacattattactaagttttataattaaaaaggaacaggcgcaacattagcctgttccttttctatatgttaaactggtttttctatagttcgtgttaataggatgctttcaaagaccacaaatacaagtaactgaggccaaaaggtaaggcctagaatattgtttgtaaagatattagtgagtacgaaagtgcagccgatataacaaaaatagtatagcgacaataatttataggggacactagaattatttgttaaacgaggcaactgaagtaaataaattaatgcaattagggttgtaatgattatcataaatcggaatcttatactactttggggatgaaaataccaaaaatcaacatgacctataattgcgataaaaataatgaaaaatagatcataaagtctttttgaccttggtcggccaccatcccaattatctaatagattattaaacatacgtaaacctctaacctagtgtatcacttattcgaagtttgggcaggatgcaggaacttatgcccaatcacctgaacggaatactggtacaacctcaccatcttgagtgacaccatcaatgtccatatcatttgatccaatcataaagtcaacatgttcatctgaaatattccatccgcgcttcgctaaattctccggtttttctgtttttccacctgaaatattagaagcataagcagcaccgatggccaaatgatcggaagcattttcatcaaagagggtattgtagaataaaataccactttgtgcaattggtgaagggtcgggtactagagaaacttcacctagtgatttagacccttcgtcagtattgatgattttttctaatacatctaatccagaagtagcttgtgctttgacaatgcgaccgtcttcaaaatctaattcaatattttcaatgacattaccttgataagacagtggaagcgttgctgccacatgaccatggatattacggttatctggtgctgtaaagacttcctcagtcggcatgtttggaatgaagatgttgccggctttatcttgggagtaagcagcctcccagacatgaccttcagctaatccaattgtgaaagcagattttgcgtttttgtaatgtagttctttgaaattttgttcgtttaaccaatcggctttgtttttgagtttgttgatgtgtagatcccagttatccactgcatcactatcatcatcaatacgcacatctttgagaatttcttcccacaagcggttcactgcatcttgtccttttaaatctgggaatactttttctgcccattcttgaccagctgctgccacaacaagccatgagatatcatctttcatcgttgcttcacgaacgcggaataatgctttttgattggcttttgtcaatgtagctaatctttctgcatcaacgtcagccaaaccatcaggatcctgtgaaattaatgaaatgcgggaggcgtatttgtccattaattcatttgctttagttacctgataatttggtacttccttcagacggtctagcgacgtatgatttagaaattctttggcgatcgtttgatctgaccattccataacaacctcgtgagcacctgctttataagcttcggcaacaattttacgagcaaaataagcttcgtcaactgctgcgtaaaggattattgtttgtcctggttggacattaacccctttttttacgatgagttcagcgtacttgttgagttttgtttctaaagacatgttttctctccgtatgagtaaatttagtttgtctgtcaattttcccattaatgcaccatgttagcaagttttttgttattgatttatcattttcgtaaggcatgttaataggcgtaagtatctattttcttgtataataatagtatggaaaatgtatttgcaagtgcctcacaatataaaactaaaaaattactaacatttacttcttggctattgattctgtctggtattgtttgttcatttactgtctgggtttttgcgaaaccagtggtgacacaaacaaatacaattcctagcggcttttcagtgcagggtgtgtcaattaaccaaacatctaactatgttgattttaataatctagcaagtaatggtgtgagctttgtttatatgcgcacgacatctggtagttcggtcatggatggtggttataaatcgagtttttcccgcgctaaatcagctcatttgaaagttgggaccattcatgtttatgatgcgagcgtcacagcagcgacacaagcacaatactatattgacaatgtgggaaacaatattggtgagctgccaattgcaatttcagtgacggctgatcagattagtacggcaacatccaagcaacgtttagcatcgctagtccaaatactagcttcgcactataatcatgacatgattatttatacgacaccaaatgttcaaaagaagttgtcgtccacaatttccaaaacaaaatattggttgattgaagacaatacaaaaaatacagacagcaagaacttatttattcaatatgatgaagatcaaacaattggatcagggttgaaggcaattaaaatgccaacgacagtgtttaatggcacgcaaaaacaatttgaggtgtacaaatgattaaattgggtattattggtacaagctggatcacggcaatgttcattgatgcagtaataaaaacaaaagcgtatgatttaacaacagtctattcacgttcacaagctagtggtgaaaaatttttagcatcattagaccttgatacagacaatgttgatgtagttactactttaagtgatttatatcaaaatattgatgtggtttatatagcatcaccgaacgctttgcattttgaacaggctaaggtagccattcagtccggcgttcacgtgattgttgaaaaaccttcgtttagtaatccaacagagtttgaaaaaatagaatctctgctagcaacacatccagatgtgcgtttatttgaggctgctcgccatgttcatcaaccaaatttcaaggccattcaggaaacagtcgctaagatggatcagttacaaggggcaacgctagtttatcaaaagtactcatcccgttatgatgcttacttagctgggcaggagccaaatgttctgacgagagagttcagtgctggcgcgttatatgatttgggcgtctatccaatttacgcagcgttggctgtttatggtgcgcctaatgccgtacagtatttacctagactattacgtaacggggccgatggtagtggtgtagccaatctattttacgacaattttaatgtaactgttatcttcggtaaaacttcaaattcgtatttaccaagcgagttttatggattaaaggatacaattagtgtcagcaatattgcagagcttgaaaaggttacttattatgatggtgaaggaaacaataatcatttaggagatgtacccgaagaaaatcccatgattcgtgagagtcaggattttgcaaatattattaacgacccaactaaaaatcacgctgaatatagtcagtggtttcagttggcgaagcaagtgaaccagacattgtttgacttgcgtcagtctgcaggcattgagtttcctgcagatataaaggaataaaatgaaacctgaacttttagaaaaatttaacgcctcttttgatacaccaacgcctatacaaagtgctgtttggcaacgcttgacggatggcgattcaatatttggtttagcaccaactggaactggtaagacattagcttttgtattaccagttttatctcgtattgacacgaacttgaaacgtacacaagtattgattctggcgcccagccaagaattggccatgcaaacaacacaggtcgctcgagaatgggggaatgttgttggtgcaagtgtagctagtttaattggtggcgcaaatggccgtcgacaagctgataaaatcaagaaagacaagccgcacattgtagttggcactttgggtcgtgtgctgacaatggtagacggtggcgtactaaaattagatcatattgcaaccgttatttttgatgaggctgatgcaatgttaactgaggaacgtcatgacagtttacaggagctagcagataagttgccttcacatattcaattaggattgttttcagcaacttctggtgtggatctaaactatgtcagcgacacgtttgaacaaaaagtgcatccgatttctgtgggaacagatgcgccggtatctattaagcatgaattccagtacgtggatcaacgtgcaaaagaaaaagtattaatacaattagcccgaaataatcaacaggctttggtattctttaatacaatcagtgctttagtgaatatgcaagctaccttgcgacacgctcatgtgagtgttatgagcatcggtagtaatgacaagcgccaagtgcaacgtgcagacgctttgcgtttattcaaaaaaggtgaagtaactttattgttagtaactgatgttgcggcgcgaggattagatattgaagatctgccattagtagtgaatgcacaattgccacaacgtaagaaaaactatgtccacaggacgggacgaacaggacgtatgggaaaaataggtcgtgtattgaatcttggtaacgatcatgacattcgtgacctgaaaagagaattaggggatagctttaatctagacaaagcagaaaacttgtttgaaaaaagtatacagtcccaagaaaagactgtcacaaaagatacaaacacaaatgatgtttcatctgtctctaaagccaaaaagtcctcaagtgccgctcctttggtaacaaaaaaagaagttatagttgagcctactacaaaagttaaaaagaagaaacgtgcaaaaagttctaaagataagggaaaaccaaagtgggctaagaacgggaaaacgaagtgattgggttagcttgatacttggttatttgcgtgacaatatgatataaagttaaaagcgcacacaatatttgattgggtgcgctttagtgcctgtgtgttaaaataatgtaatatagaaataatgcaaggcaaatttataaaatcaagctataaaacaattagtcttgttttacaagacagcaggagggaagatgccagaactaccagaagttgaaacagtcagacgtgggcttgaaaaactaattattggcagcaaaattattgatgtacagttactttacccaaaagttattactggtgatgggcagcagttcatcaccggtgtcatgaacacagaatttaaacaaattgatcgtcgtggcaaatatttattactacgtttagcgaataatcatacgattgtttcgcacctacgaatggaaggacaatattcagtagagtcccttgagacggtcccttataaacatacagagattgtctttgaattatctgataagcgagctttgttttacaatgacacgagacgctttgggcgcatggcgttgaccacaactggttttgaaaacacagaagtgccttcgttgtccaaattaggaccagaaccgacagaggagcagctgactttatcttatatgaaggccattttttcaaagtctagaaggcctgttaaaacatttttattggatcaaacacaaatagctggtattggtaatatttatgctgatgaggttctgtggcaaagcaaaattcatcccaaaacgccggccaatgtactagatgaagttcaactgagtgttcttagagcaaacatcatttcagaaattaaacgagcgattaagcatcatggtacaacagtgcatagttttagtaatgtttttggtgaggtgggcaagtttcaaaatgaattacaggcttatgggcatgctggcgaaccatgtttacgttgcaatacgccaatggttaaaataaaagttggtcaacgtggcacgacattttgtccattttgtcaagtggagaaggattaatatgaatcaagaaccaataagtattattgacgtcaaacgcgacgcaaagaaattgatgaagggtcgactaggaacagctatcaaaattaatattatcgcgattattgtgacagtgacgaccttatcaatgatgactttcacagtgtatgcgatgatcaaagacgccaatctaatgtctagcgctgatgtttcttcaacaacaacatctctgggtctgaatccgagcgaagtaattgtttcagtattgcaagatgcagctgggctaacatttatgtggtctgtttcttggacaattattgattggtttaataatcctaaaaagaatccaagattcattcaaacttttcaaatatttaataatggtaaatttgcgcaaagtctgctattagccgtcgtgcagtccatgttgactttcctttggacgatgctgtttacaattcccggattgattaagcattattcctacgctcaaacgtattttagttataaactagatttggatgctggaaaacaagccaatgcattgacagattatattacacgtagccgaaaaataatgaatggccgtaagtgggaattatttttattagacttgagttttattggttggcatttattaggaatattgacagctggtttggcttacatttatgttattccttatttgaatgctactaaggtagcttattcacgtcggttatttaagctaaataatgaagtaagcgaggaacagtaaatgttgacagttggtttaacaggtggaattgctacagggaaatcaacagttagcgctttgttgcgccaagcaggttttccaattgttgacgcagatatagtggctcgtgaagttgttgagccaggaacgccaacgcttgagaaaattaaattagcgtttggtccagggataattgacaatggcgtattagatcgacgtaagcttggtcaaattgtctttgaagatggtgcccaattaaaaaaattaaatgatattatgcaaccagccattagcagtgctatggcagataaaattaatttttggcgtttacaaaatgtgccaatattagtcctggatgtgccattgttatttgaacgagactatgataaaaataagttagtagacaaaataattgttgttactgctagcgaagaaatccaattatctcgtttggaaaatcgtgatcaacttagtaatatggaggcacgtaatcgtgtaaaggcacagttaccaatgacgcagaaaattgcgagagctgattatgttatagacaataatggccgtatcgaagagctacaggaacaagttgcagttttaatcaaaaaaataaaggagatcgcgtcaacgcatgatgcaaaatgatggcacaattgagtttcacgctaaggctggtgtttttgtgcagtcaaacacaccaatcacattgactgatttagatcgtgcttttgatttatacacgccgtttattggtgcaactggatatgcattgtaccatatgttggtaagagaattaccctacaatacacaactagatgcacgtgaagatcataattttattttagatagtctgaatgtcagtttacccgattttgttaaggttcgtcgtcgtttagaagcggttggcctattgacgacactttatacggaagatgctttgggagaaatttatacgtatcaattatttgctccgcttgacgttgacagttttttcaaagaaaaattattggccggactattgtttaaatatgttggggaagaacgttatttaacactccagaaacgatatgctacacaaggacaaccaaacgtgaagggggataatatatccgccaagtttttacaggtcttcaagcacgacacagctacctcattaccaacagttgaagtaaaagcaagtcatggcaaaattgaaatagaagatgactttaattttgaaaactttaccggcttagtgagaggtacaacaatagaaaagttggcacaacatcgtgatttcttagtatcgatgcacgtgatctacggtgttgatgaggtgacgctggctggctacacctcccaggcaatctcattagatacgcatgatgttgacgaaaagattttgcagcaagttatgcgtcagaatcgtacaaccgtcgttgcagagccggtggtctcacagccagtacaacaaaaccgttccagagaaatgttacaattagttcaagatgcaaaaacattagcgcctaatgcctttattgaagatgttaagtttaaaaaaggtggcggatttgtgacacgaaatgaatattatttcatcagtaaaatgatcaaagatgtgcgcctcaaagcagaggttgtcaacatgttggtttggtacgagttgggtaaacgaaatcgtgatactgtcaatgttgatacagcggaaacaattgctaattcatggttgaaaatgcatgtgaattcggctgaagcagcactagatgcaattgaaaaatatcaacctagtcgccctacaaagcgaaactataccaaaaaagtgacgcgtgtcgaaccaaaaatgccttctgatacttcccaaaataagccagcaacttctgtggatgaagtagcggaagccttagctgaactaaaaaagttgaatattaagactaagaattgagattaatatgcagaatttatctgaagtactcaagcaatttcagcaacaatatgctaataaagctaatttatcggatattattgaatccattggaaaggatcaagatatacgttctttttggaatgagcatcaagatgaattgaactcagatgcttttcaacttaaaatgggtgatctgtatgagtacattcaacaaaagaaaagaattgcagctggggaaaaagttctctatccaggatattatccacagttaacgattgaaaaaggttatccaatagttcattatgttgctgatgaaaaaacacgcaaacaattaatgcaacgtgaaaaactgactttgtacaaaatgccaaaatctgttcgttcagcagattggagcactatcgggcaggaaatcattgatcatgcccaagaggaacagggtaaaacggaagcatttgtttcgctcaataaaattctaaaaagcttaactagtacggtccaaaataactttgttcaaggtatttatttatacggtgattttggcgtaggtaaaacatatatgatgggggctcttgctaacgcattggccgttaataacataggcgttatgttattacatttcccttcatttattagtgatttgaaggcaacatttgatcataaaaatgaatctttggatgaattattaagtaaggcaaaaagtgtttctgtgttaattcttgacgatgttggcgcagatacgttgacagcgtggagccgagattcgattcttggtattattttggaataccgtatgcaaaatgagttaacaactttttttacctctaattttgatgcgaatgggtttgaacaatatctgtcgcaaactagggaaggtaatgaacctattaaagctgctagactcatgcaaagagtgaagtttctagctaagccggtccaaatgacaggaaaaaataaacggttagaaaattgatattcctaaaaaaaacaaaaaattattggtttgtggccattgccgtaattgctgcttggtttctattgagatctgattcatttttgtatcaagagccagtagggcaggttacgcatgtcaaagttcagtccaaacaaaaaacgacagatgagcataataatacagataatatttatcatcaacaattaacggttaaactgttaaacagaaacaaaatcattaagttgacaaatcaatacaccgattcgcaaactgtgacacataagtacaaagttggagaccagctattattaacagggcatgcgggacattttcgcattatatctcttaaacgtgacgcagtcatcggatctttagttgttttactattagggctgttattgatttacggaaaatggcgtgcgacgtcatggctaaccctcagccttgtcgctaatgtgattctttttgcgattgcattatatatagatgttcatcttaaaaatccgaatgtcattttgatttttagtattttagctatcgttgtagcctcactgagtttggtattagtattgggcagaacccttcagatggtggttacgcttttggcaactcttttatcaacggtccttacgatgttcattatgtttgttgcccttaaaattacaggtaatgaaggtgttcattttgaaacaatgtcgtacgtaacgcaagtgccagtgactttgtttatcgcccaaacgattattggtgttctaggagcggttatggatgaagctgcagatattgttgctgcgttatttggtctgcgtcgtgaaaaaattgatcgtcacttcaaggactattggcatgcgggaatgaatgttgggcgcgatattatgggtacattaattaatgtactattcatgattttcattgcggaaacaatgccgatggtttttttgatgctacgaaatggcaataattggccctatatacttgaccaaattatgaacctaggtattttacagacagttatttctggaatcggcattgtattagctgtccctgtcactagtgctttggttggctggattgctgagcgatacaaggtggtggactaatgaatgcaattggattattaataattattttatttattttaatggtatttgttggcggtgttcagggaatgaaagcttttgtaggcttggtgttgaactttatcgtcattttcattttaatgattttaatcaattggcaatttaatgcatacattgttacggctttaatgagtgtcattattttggctcttgcaatttatttaggtgcagaaaatcaatttgtgactaatacagcttttaagacaagcttaatagttgtgtcaattttgatggtagtggcgattttggttcagcatttaggccagtttcaaggatttgcaaccgaaaattcggaagaactggaaggcttatcgttgaatgtcggtcttcctttcacaaaggtcgctgtaattgtaatggttatatccattttaggggctgttgctgaagccgcaatggctattgtggcggacttgaatgaggttatagagcgtacaccaaatttgagcaaaaaaagtctatatgcgcatgcacatattatcggtgggcaaatattaggtacagctattaacacacttttctttggggttttaggggccaatctaccgcttttaatctggtttattcgcttacggtattcaatcgcaatgttttttaatgcaaagttattaatgatggaagttgttacaatgttgttgggtatgctaggaattttgatgagtatctgggtagctagtcgattagttgtacatgaatatgtgaaaatacaaagcaaaaatatgagaaaaggagaatgaagtccacttctaagacttcattattaaaacttaattcactatgaaagaaacttttgatttaattgaacgaatcacacgtaatgacggcagttcttattttgaactaggaaacatccctcataatggtcgtgctgagtatgcggctgaacacgggtttattcaaagtgttcagattttgaaagtgaacataccacgctccactcacgtagaaaaagtggaagagtatattaattcacactataaactattgcctttggaatatgatggctgggaagaatgggttaagacacctgaaattgaagaagagttacaaagaatacttttggataatcggttgggctaactgaaaaccgtatttaaagaccgattagtaacaatgtatatgaaaagtaaccaaaatgttgtaattttgatcaattttatatataattaagagcgttgttgtttgatgtgacaacgcaaataagtttggtagtgtagccaagtggtaaggcaacggtctgcaaaaccgtgatcgccggttcgactccggttactaccttctaaatatgataaacgctgtaaaattttatggatgctagtttaattgaacaagctgacattataattttagcagtgttttttatataagaaatagttatgattgaagattttgcctgcaagcgaataaaaagctatttggtgaaaaaatagataacatgaaaaatattgttgatgtctttcaaccattgaattgatgttagcgtttgacgagcaaatacaggcagacactgccaactattttttaaaaaatgaagtcaagaaatgatatagatagcattgctctgctgttgctgttgccacgctatccgtacttttttatatgttataatattcaagatgataaccctaaatgacaatgtgaatattttgccaggtgtaggtcctaagcgcctagatgcgttacatgaaattggtatttttaccattgaggatttaattaattattttccatttcgttatgaagacttaggagaacggctaccctctgaaacattggatggagaaaaggctacttttaagggaattgtgagtacacccgctgttgtgactcgttttggcaaacgatctcaaacacgttttggactaatgatagagcatgaaaatatacgtgtatcattctttaatcagccatggattgctcaaaatgtcgaggtcggccaagaagttgctgtttatggtacttatgatgctgctaaagcgtccttgacaggaatgaaagtgatctccaaggcttccaatgaacttgacccaatttacccttcgtcaaaacaaataagcgctaaaacaatacgtcatttgatagaaattgcgtgggctgatgtacgtggtacagttggctcgttagtgcccgataaaattcgtcaaaaataccgtttactagacagaaatacgcaaattgaaaatatgcattttcccgctgacatggagcaagctaaattagcacgccgaagtatagcttttgaggaattttttatatttcaaatgagattacaattgctcaaattagctgataagaacttttccggtgaaggtattaattatgatagtaaagcgctaaacaaatttgaagctggcttacctttcacattgacgggggcacaacaaaaagttgtttctgaaattttgaaagatcaaaaacgtccagttcacatgaaccgcttattacaaggtgatgtaggttctggtaaaacggtagttgcagcaattgcattatatgctgttgtcaccgcaggaatgcaagctgcattgatggcgccgactgaaattttggctcagcaacacgccattaatttagcttcaatgtttgaaaaatcaggcgttgacattcgtattgaactattgaccagtggtatgaaagctgcggctcgacgtcaactattagaagatttagctgacggaacaatagatatcttagttggcacacatgcgttgttacaaccggatgtaatgtttcatcacctaggtttagcagtgattgacgaacaacatcgatttggtgtcaatcaacgtgcaaaattacgtgaaaatggtgtgaatcctgatatactagcaatgacggccacgccaattcctcgtaccttatctatcactgcctatggagaaatggatgtatcaataattgatcaactacccaatggtcgcaagcaaattcagacacgaaagattagtcataatcaaattgactcggcaattaattttcttaaacaacaactctcagagggcgcgcaagcatatgttgtgacgcctctgattgaagagtcagaagcattagatgtgcagaatgcgcaagcaatgtatgaagcattacaacttgaactgccaaatgacacaattggcttacttcatggtcggctctcgaacgacgaaaaaaaagctttgatggccgactttaaaagaaacaaaattcaggttttagttgctactacagtcattgaagtgggtgttgatgtacccaatgctagtatcatgttaattatggacgcagatcgatttggattggcacaattacaccaattgcgcggtcgagttggtcgtggtacgagacaatcgtacacgattttagtcgcagatccaaagaccgattatggccgtgctaggcttgatgcaatggttgagacaacagatggttttctcttagcgcaaaaagacctagaactacgcggttctggcgatatattaggaaccaaacagtctggtgtaccagaatttgccgttggggatccgattaaagacttgaaaatgatggaagtcgctcagcaagaagcaattagtatggttagtactgacgattgggataaatcctctgaaaatcaggaactagtggattacttatcaagaacaatggcgcattatcggcacttagattaagcagtgttggcgtaagaatagagattaaaaatggaaaggaacgtgttcagctaatattagttgacacatttaaaaatatgaaaatcgcaatagatgcaatgggtggcgattacgcaccgatggaaatagtcaagggtgtagaaatagctcgtgatcgttatccagatattgaatttttactctttggaacaagtgaacaggttaagccacttgtaaaggattggtcacatattaccttaattcccacaactgaagttattgagatgggtgatgagccggttaaagcaatgcgacgtaaaaaagactcatcaatggttcgtgccgcaaatgccgttaaagctggcgatgccgatgctttatttagtgctggaaatacaggggccctactatcaagtgctattttcttgattggtcgtatcaaaggtgttgaccgtccagctttggccaccgctttaccaagctttgctggtgaaaatgatcaatttgtatttatggatttgggtgcaaatgctgaaagtaaagcctcacatttatatcaatacggaattttagggagcttttatgcttctcatgttttaggaattaatgatgcacgagtgcgtttattgaacaatggcgcagaagaggataaaggggatgaggttcataaaatagcgcatcagctgatgaaaaactcacaatcttttaattttttgggtaatgttgaagcacgtgaattattagaaggaactgcagacgtggtggtagctgatggcttttcgggcaatgcagcattgaaagcaacggaaggcactgcattgatgatgttgaagcaaattaagcaggctattatgcaaacagggcttcgtggtaagatgggcggtctcttattaaagccagctttcaaagatattcaaaagaagttggactataatgaagctggtggtgcagtaatcttaggtgttaatgcgcctgtcgttaaaacgcatggttctgccaaagctaatgcagttgctaatacaatgggacagattaaaaaaatgattgaaaaaaatctagtgccagatattcgaacatacattgcagaccataaggatgagttgcaagctgcgaagaatgaattgcagtcacaaattagtgaataagttatggtataatagttctttagattaaagattctgggagtaattactgatggcaatggaaaaagaagcaatttataatatgatggcggatgaaattgcagaacgatttaatgtgaaaagagataccattacgccggatttgaattttttgacagatatcgatgcggattctatcgactttgttgagctggtattagaagtagaagatatgtttaatgtcgaaatttctgatgatgatgctgaaaatttggttacgttgcaacagacagtcgactacattgttgaacaccaaaattaaatgtttaaatactttgtgtcattcattggactaacaaacatttacaatatagatacgttttaatgattccaggcattgtactgaatcatgatatatttttgttaaagtaagtcctcacaaattgttatttgtttggggactttttgtatggttggccaaaatattaattgaaacgatgtgttaaaatgacagataacgaattacaaaatcttgttgagaaaatatcatttgatagttttgatcgtccatttcaacatcatgcaacattcaatagccatctacgaacaacaggtggtcgctatcttttgaaaacacatgatttagaactcaatactaaaatggttacattagaagactttaacaaaattatcaagcatgaattggtacactatcatctacatttaagtcaccaagggtaccaacataaggatagcgattttaaacaattattagtacgtgtgggcggtattcgatatgcacctgatattggtgaaagacaatcatctaagtgtcagtggttatatcgttgtgaaaatgggcatgatattattcgaaaacgccgatttcaaactgaacgctatcgatgtggtcagtgtcaagcacggataaaatttattggtaaattatcgaataaataaactgttttgttataatgaatgtacaaacacaattggagattataatgataaaattgattctttcagatttagatgaaacgttgctcgatgatgatggtacgattaattctcaaaatgtcactgctgttcaaaaatttgtgaaaaatggcggctattttgttcctaatactgggcgttcttataagtctgtttttggtacattaaaggatctaggcttaaacaagcaaaacaaacagtacgtggtttcatacaacggtggtgcaatcgtggaaatccatgaagatggtggcgaaaagattattgtccaacacggcatggatttagaattagccaagaaaattttctctcttggccagattcaggcggacattgatacacacatctacacgatagatacactattcatttataatatttcaaaaaatgatgaacaatatatgagagaacgtagtgtgccatatcaagaaatggccaacgataagttagattttctttcgaatgaaaaaacgataatgaaagttatttttgaacatcatgatccagatgtattacaaaaaattgctgatacggttaatgctcagcttgctgatagggtattgacaacattcagttccaatcgttatgttgagttcaatcccaaggggagtgacaagggttctgccggattagaattagctgacatgctgggaatatcacgaaacgaagttgctgcgttgggtgataatttgaatgatgcagctcaaatcaaagccgcaggcgtaggtgttgccgtggcaaatgctaaaccggaaattaaagaaattgctgacttggtattgtcaaaaacaaataatgaaggcgcggttgcggaattcattaatgaacatacaggaaaataaatgggtaatttaattacgagaatcatactgtcggttgttagtttcgcactttttgtcctaatattcttgttgagtgaccaacaaaactggccattatgggtaacgataacgcttgttgctgttttgttcatcgtgtttaacatttgttttgtatggctgtattggcaaaagaaaaagcgcacactggatgaggatgacgatgcttgaaacgacaaatgaagtaagaccaaaatctttactgcttagaataatcaatgttgtttttacgctatttttaatagttgtggcacccatccctttggtccttgctacaaaaacagataatatatttttacaaatattgtgtgccgcaacaatgttcattttttatataggcattgggttctatgcttatagactactaagaaaaaatgtacctggcccagtctttaccaaaccagatattcgaaactggcgaggcctctggtggctagtaggtatgtggtttgttatgatagccatcgagatgatactagctcaattacgggttcaactaacaggggttaccacaaccgaaaatcaagaggctattaatgagctaacttcaaatttaaatgtgacaatggttgctatggtaatttatggtacgtttttggcacctgtagttgaagaattagtttttcgtgggcttattttaaattattttttccgcaaaagttggtggtgggcaaatattattttgtcgggggcagtttttgcactgccacacatggatacgattcccactaatctcgccgacaccttaagttatgtgatatacgctagcatggggatggtgctcgcctacatttacaaaaaaaatggtgatttgaaaaatagtattgccgttcatatgttgaataatggtataacaatgataccattgctaattgtagcaattatgaatgctatataataaaagaccaatgacttaagtcattggtcttttatttatttcagaattgtagtagttctttggttgtgtgcgtataaggaatgaaaccttctttactcatataaccactatcttcaatacggacaccagcaacacctggaacgtagataccaggttcaatagaaaagaccatgccttcttcaagaatcatatcatttcccgccatgattgaaggaaactcatgtactgatgagcctaagccatgtccgagtcgatgattaaaatattgaccatagccagcttttgtaatgatatttcgtgcgatgtcatccagttcgctggctgtcataccaattttagcttgtgattgggccgtgagttgtgcttcgagcgtaatagcatgtatttttttggcttcgtcgctcacgtttccaaaagctactgtccttgtggcatctgaggcatatccttcagtcatcgttcctaaatcaaacaacgccatttcaccagtattgagtgtatttgttgatgttgaaccatgtgggtcagcggcgtgggccccaaattgaactagcgtttcaaaactcatgctagctacgcctgcttttttgagttcatattctaattcagcggcaacggctaactctgatataccaatctctagagcgttaaagccaatctcaaaggcgcgatccgcatcacgaccagcggccttcatatgtgctatttcgtctggtgtttttattaggcgaagttgattaatttgatctgtaatgtcaatagaaaactctccatcaggaaaggcggtttgcagtaatttaagacgtgcaactgttagattatcggcctcaatggcaaactttttaccgttggttaatgttctaatatggttagttaaatttaaccaaggattttcatggtcttcatagccaaaagcagcatagcgccagccactttctttcatactgttgacttccagtgctggtccaaacaaaaaaggttcactattttccagtagaacgagcgctaaaacacgttctattggatcagattcaaaactgcttaaataggcaacactgtggtaatttgtaatgatagcgcctgacaactcttgtttggtcagccagctagttaatgcgctgattttttctgcattcatgacactaactcctgtgaaattttatataaatacattgtatcactttcatcatgatgaatcttttcttgtaacaaagtgaaacaatgatgaaaacacttataattaatgttgtaagcgtttgcaatttgattctgatttgatataatagtgtagataacttctaaaaaaaataataataaatgtattaaagaggaacaaattatgcaaaaaaagcaaacggctacaatttatgatgttgctagtcgagttggtgtatcactagcaacagtatcgcgagttgtaaatggcaacagtaatgtccgtgaatctacgaaacgtaaagtattggatgcgattgaagaattaggttaccatcccaatgctgtagcacgtgggttggcttcaaaaaagacgactaccattggtgttgtgatgccagacgtaacagacatgtactattcagagctggcacgaggcattgatgatgtcgctaatatgtatcattatgatgtcttgctaacaaatacagatgaagatcctgtgcgtgaaacaatggctattaacaatcttgccagcaagcaagttgatggcattatttttatgggcaatgaattggatcgtgaagttttaaagacaatctcctctgttgatgcaccgtttgttttagctggttctattgatgctgaaaaggttttgccaagtgttaacattgactatattgtagctactaaagaagcggttgaaatggtagttaaaaatggacatgaacgtgtagcgttagttaccggaccaatggaatatgcaattaacaaacaacatcgcttagttggctaccaagcaggtctagaagctgccggacaagagtttgatgaggatttgttatttgcctctcatcaggactattctgctggctatcaaatcgctgataaaatttttgctactaatgcaacagcagctattgttcatgatgatgaagttgcattaggaatcatgaattatatgcgcgatcaagggaagtcagttcctgaagattttgaaatcatcacatcaaatgatacaaaatttgcaattgtgacgcgtcctgcgctaacatcaatcggtcaacctaagtacgatattggtgcagtcgcaatgcgtatgttaactaaattgatgaataatgaagtggtggataacatgcaagttacgttaccacatacatttgaaaaacgaggaacaacaattaattaagaaataatattgaaatatttgacatgttacgttaataaaagtaaaattagagaaatgatgtagatttcgtgtatttgagattattgagggaacataacggtcaaaattatggaaattccaaaaagacgttatatcaagggatttgatggcttacgtgctttagctgtcattggtgttattttatttcacttaatgcccacaaaatttgtcggtggctggtttggcgtgccacttttttttgtgatttcaggatatttaattactgatcaattgatacaagagtttgatcgtaatcacaagattgcaatttttaagttttataaacgcagattaaagcgtttgtatccggctttagtagccatgatgttgatagtgactgcggtgattttgctttttgatcatcagttaatctacaatttacgtcctactgttgaaactaatttattgtatgtctttaacttttgggcaattggccatggaccgtcctattttcaacaatttggtggtgcttcgcctttcacacatctatggtcactttcgatagagggacaattttattttatttggccgttagttgtttgggctattttacgattgggtttgaagcgaataaatattgctagagtactaattttgctttcattaattagtgcaatattaatggctgttttgtatgatcctactgctattaatcgagtatattatggcacggatacccgactatttgctatcctattgggcacagccctagcatttgtttggccctcgattaagctctctaatcatgttagtagcaaggtgcaacgctatcttaatattgcgggattctgttcctttttactttggggattaggaacactatggttgaatgggcaacatcctgcgacttattatggattaatgtacttgttaactatagcaagtactgttttggttgctgtaacagctcatccggcttcctggcatgccaaaatattggataacaaacttttaaattatttagggaaacgttcctatagtatctacttatatcaattaccagtttttgtgttttacgaaaaatttatcccacattatcaaccaaatgttttgaatatattgattgaaattgcgcttgttctgttgctaagtgaattgagctaccgctatgttgaaaatttgttccgtaatggagaaaacctgcgccaagttggtcattggttggtgcaatcacgtaatcgatttttcttaattttaacgcctgcgctgatttttttgtttttcataggtcatggattggcaagtcaaaatgctggtcaaccgcaaccacagactgaattacaaaagaaattactcaaaaataaattggcggtgaaaaaaagtaatcaaatcgctcaaaaatcggctaaacactcttctaagcaatcaagtaataaaaacatgtcggcagctgataaaaaagtaattgcaacatatgatttaaacgctgcacaatacatgagcttcaagaatatgtcatttacagctattggtgattcggttatgttagattcagcaccatatctccaagacattaatcccaagatagtggtcgacgcaaaggtggggcgtcaagcctacgaggcaccgaatttagtgaaaaaaatggctcgcaacgatgagttggcaccgaacgtcatagtaggattaggaacaaatggtgagattagaagacaagatttagatcgcatgatgaaaacctttggtacaaagcgacaggtttattggattaataatttagtacagagtaaaccttggcagaaagataacaatgatatgttggcgaaagctaataatgattataaaaatctacatattattgactggtatcgtttggcaaaaaaacattcggattggttcgctgatgatggtgtccaccaaggacctcttggcgcacgaaattacgtcagattgattgttgaaaaaacaggtgatgtgaacaaaatcaagtaagaattagcgcatgcaacgttttaacataatatcattataaattatccgtcaaaagttgaattttatacttatttatattagaatgaatataaataagtgtttgagggggtattatgtttaaaaacatcagaaaattaacaccattttcacttgcgttattatcaattgcatttatcatgtcgattagtcaatctactatgacaacggcttatccgattttgatgaaaagttttaatgttaacgcgagcactgttcagtggttaacaacaggttttatggttgcaatgacactagtcatgccgctaagtccttggcttttggataatgtgtccttacgtaaattactcaatggaattgtagccctctttttactaggaacgtttttggctatggttacacccaactttaccggtattattatcggtcggttgttagaaggtttagcggtgggggccttatttccaacttttcaaagtgtcatcatggaaaatactgataaaaatcaacgaggtgtagctatgggcgtagttggtttagttatgggttcagccttagctgttggtccgattatttctggcgtggtcctgcaatggatttcttggcgtgctttatttatgttattttttgtcatattgctgattttgattattgttttgcaaaataaaatagaaaacacgcacactatggaaccatctgaattcgattggttttcggctataaccttactcggatttggcggcattttgtatgacatttcaatcattccaacatcaggaattaacttctcgtggtggttgattttaataattagtgtcagtttattagccatatttatcgttcgtcaagtaaaattacctcaaccgtttttagatttagcggtgctcaaatatagaggttatgttccagctatgtttttaacgggattatcatattcaggactaattattgcaacggttctgatgcctttgttttatcaaaaagtttttcattttagcccattgtggtcaggactactcatggtacctgcagcaatctttctcagccaattgaatccaagatcaggggcgatgctcaacagaattgggttaaaaaaattagtttatattggtatggcaatgatgcttgtagggtatgcgattttgggtactttagggtcattttcgtggatagcgtgtttgatagcagctatgttacttgaaggtggcaatgctttcattatgatgcccgcaattactgcggcaaataacgcactacctaaaaatttagttagtcatggtactgcgattattactacgatgcgtcaagtcattggtgcaggaagtgtggttgttgcttctattttaatcaccgcaattaataccaattcatcatttgtacatgcgttgttaatgacaagtcgctggtttattgttgtgccactcattggattactactgacagtcagaatcaagtcgaattaactattcggttgagaagatgtgatgccgacttgattgcgttccacgataaagcatgctagtattggatataataaattattaacggttgggcgaaagcttcaagaagttaactagtcggggagctagttgatttttgaagcttttttctttttgtttaggagaaataaacgatatgataaatgttctattattaatcacagtaactctatttttcggaaaagtagctgtaaaattaggcctttcagaggtcataggtcaattacttgctggcattgtcttgggcatgagctttttaaacgtcgttcatagcacatatttagttcatgtgctgtctgaaattggtatttttatattgatgctaagttctggattggcgtcagatatgaaaacaatgaaaaaatatgtcaaagcttcatcattaatagcaatcatgggtattgttattccgatgattgcatttccaattgcgtttattttaatgggatatagtgtatcagtctctttgttttcgggtatagttttttctgccacatcaatatcaattacattagctgttttagctgagcaaaaaaaattaacatcagcagttggcgcaataatattgtcagccgccataattgacgatgtcatttcattgctagccgttactttattttccgtatttattggtaatggtggcttcaatatgagtagcctgttaccattaattgcttttgttatcggcatttttctgaggaaaacattgattgcggatcaaatattcgaaaatacaaatcgggttggacagtggattttttatcctatgttctttggatcaataggcttgaatgtttcgataggacaattgaacaataaaattgtagcgattgtcttatttattttgttagcgattatcacaaaatttgttggatcatggattggagctaaaatatctggcttgaacgatacagctgcaaaagctattggtgcgggtatggtatcgagaggtgaaatggcattagtcattacacagataggtttatcatcacaagtcattagcgctgcagtctcaggagagcttatcttggtgattattttttctacgctcattgcgccaattttaatgaaaccattatttgctaacatataaaaagcttattttatattaaaaaaagaatataataacaaaataggtatacgaatctcatcgattaggttattctaaattataactagtattcgaaagggatcaattgggatgaaaaagcagggcataatttgtggggttttaagtgcgactttatttgggattagtggcatattggcaagtattttatttcgtaatcaaaatattaatccggagtggctggttggtgtcagaatgagcttgtcaggaataattttgttaattgtattattttgttttttaggccgtcgggtttttgaaatatggttgaacaaaaaagatgttgttctaattattttatacggtatcgttggtgttttgttagcacaatccagtttctttttatctgtatactttggtgacgcagcaacagcaactattctgcaatcacttggcccaactatcattgttattttattgagcttagcgacgagaacgcttccttctcgcttagatatttggtcaattctgattgccttaactggtgtatttttgttaattactaatggcaacatcaatcagttagtagtaaactctaaagctttattttggggtatactatctgcatttggtttagttgcgtatacacttattccaaaacctttgcttgaaaaacagtcacccttggttgtagttgcttgggggttattggtgggtggaacagctgagaacttttttcatcccatttggtatataccatctcaggtgagcactaaagactggattatcatggtgtttattattatagctggcacattactaccatatgctttatatgttatgagcctgagccaattaaaacctactacagcaagtttattatctaccattgagccgatggtggcgactcttttgtcggtgacacttttacatgttcacttaaggatgtttcaagttgtaggaatcttgttcattatttcaacaatatttttaatcagcttacccctcgaacgtatctttaaaaaaaggcttagtgatcccaaaataaattaagtatttgctcaatttttctggtttatttgcattattatactgataaacttaaaatgataggtaagaagtgaggcaaaacatgacaacaatatatcaacatggtacattagcacaattagtagcgcgccaaatgtcagggacaataacagtcgctgaaatgttggaacatggggacactggcattggtacttttgagggtctcaacggcgaagctatttttctaaacggggaagcctatcaagctgatagtacaggaaaagttcaccacattactgataaacaaactacattaccttttgcatcaatccattttgatcaaccagaggcaagccaaaaattaccttttaaaaaaataaaatatagtaatttgactcagaacttgaaagatgagcagttatttaacgttttctctgctttaaaactgcatggtgagtttgcccacgttcacgttcgtattgtaacaaaacaagagaagccatatccaagtttgttacaagtagctgaacagcagcctgaattcaaagcagacaacataactggtacattagttggatattacgcaccaaaagtttttggcggtccaaccgcagcagggtggcatttacactttttgtcagatgatttaacctttgctgggcacgttttggattttgaagcaacagatgtcgatggtactttagaagtttttgataactttttgcaacatctacctattaataatgctgactttagaagcatgaatcaggatatagctggtttggataaagccattgaggccagtgaaggcggaaaaaattagcagtattcctgtggcgaatgctatgtgaaaagtaataatatcaaaaaaaggagctcattgagctcctttttaatgtgatcttgtttcttcaataacatcgcgcatggtatcaacaacactctgagtatcttgcgataaatgtgaaccaactaaagtaaataaagtatcgatgattgtaagttgtgcgattaacgaactcatggattcgcttcggaaattaacttcttctgccaatgataataatactagatccgctagttttgctagcggcgaatctttaaatgaagttactgcgataattttaacatgttgttcgtgcaacttttttgcgatgagaagtgtgtctttatttcgaccggaatgtgaaataacaactgcagtatcatttgaattgagtttaacggcttgcattaattgaacatcataatctggatgggcgataacgtcaattggtgtgcgcagaaatttgtggtaggcattaaaagcaacaatagaagatccaccaataccaaaaaaaccaacgcgccgagcagatattaaagccaatgtggcttcgtccaactgtgttgctgttaagttactaacggttgctgctaaagcattttctgcaccgccaaaaactttttgagcaaccgcaatggtatcatctgtatcagctatttctccaaataaatcgacagatgctgccatttgcgtggcagcacttgctagtgaaacagaaaattcacgaaatgattctaagccgatttttttgacaaaacgtgaaatagtggcggtagaaacacctgataattcagacatttcctgaatgttggcctctcgagcttcactaacatgattaataatgaaatcaattaatttttgttcagttgtattatattgtttacgttgtgcccgtaattgggctatgatgttatttgccatttttaatgctccaataaactaataatacaagattagaaaacaattttcaataataaggttgcaatgtgtaaattattttcatataataaaagtgtattaaaaactcaaaaaacaaagaggtaagtagacatgaagtttgcgatgatcggccttggtaagatgggcttgaacttggtaaagaacgccgttgataacggtcacgaagttgttgcgtttgatttaaacgctgactttgttaaggaagcaactgactattcagcatcagttgaagctgcttctgacattgatgatatgttgtcaaagttgccatctccaaaggcagtttgggttatggtgccagctggtgtaccaactaactcaacaatcgatacattgattgagaagatggacaagggtgacatcattattgatggtggtaactctaactacaaggataacttggaacaaaacaagcgcacatctgctgctggtattaagttctttgatgccggaacttctggtggaatgaatggtgcccgtaatggtggtaacttcatgattggtggcgatgatgccgaagcttggaagatcatcgaacctttgtttaagtcaatttctgaagaagatggttacttgtacacaggtcgtttgggttcaggtcactacttgaagatggttcacaatggtatcgaatacggtatgatgcaagcaattgctgaaggattcgaagtattggaagcctcacaatttgactacgactatgaagctgtttcaaagttgtggaaccacggatcagttatccgttcatggttgatggaattggctgaagaacaattcgccaaggatccacatttggatgctatcgctggtcgtatgcattcttcaggtgaaggtaagtggacagttcaagaatcattggacttggacgtaccggcaccagttatctacttatcattagcaatgcgttaccgttcattgcaagatgacacatttactggtaaggttgtttcagctttgcgtaacggcttcggcggtcacgcaatggatgcagctaagtaattaatagaaaaactgttcagcttaatgaacaaagctcccgcttaagggagctttttctgttttggagagaaaatattaaacgcttaacatcgattggaggtaaacaaatggagtatatgataggagttgatatcggcacgacatcaacgaaggcagttctgtttgatgataagaacgttgtcgtagcaagtgcgaataaaagttatgctttgtaccgtgatttgcctgatatggctgaagaagatcttgatgaactttttgaggcattggtttccgcattatcagaggttgtacgtgtagctgatttgaataaaggtaatcagattactgccgtatcatttagttcagcaatgcactcattaattgcatttgatgaagattggaacccattgacacgcgccattacttgggcagatacgcgcgcggtgaaatacaccgaagaattgaaggccaacggtataggccaacaaatttataaaaataccggtacacctatccatccaatggcgccattgtccaagctattatggttaaaatcagaacatactgatacttatcaaaaagcagcgcattatttgggcattaaggaatacttattccatcgactttttggttcaaataagatggacatttctattgcttctggaactggtttgttcaacatttttaatttggattgggatgaccaagccttgtcagtaactggtgttcgtaaagaacagctgccacaaccagttgaaccttatgaatacgaaacaagtatgtttgaaaaatatgctgcgttgattgatcttccagcaaacacaccatttgtttacggtgccggtgatgggccgctttcaaacctaggtgttaacgcagttaaacctggtgttgcggcaattacaattggtacttcaggtgctattcgagtcgtgtcagagcaaccggttatcgaccctaaaggtcgtacgttcacctatgctttggataaagataattgggttgtgggtggtcctgttaataatggtggggatgtcttccgttgggcacgtgataatatgtttgatgctgaaaaatcaacagctgccttacttggaaaagattcctatgatttgttaacggaaattgccgagcgtattccagctgggtccgaggggttgatttttcatccatacctaggtggtgaacgtgcaccaatttgggatgccaatgcgcgaggatcgttctttggtcttaatcatgggcatacgcgtgcacatatgttacgcgcagtattagaaggtattacttttaatgtgtttatggttagcttggcactcgaagaagttgtaggtgatttgaaatcaatccaagcaacgggtggtttcgcacgctcaccactatggcggcaaatgtttgcggatatttttgaacaacctgtaacagttccagaggcatttgaatctggggcgctggccgcagttattgttgcacaaaaagcactaggaaaaattgatagtttatatgagattgagaaatacattggggcagctaatacgtattttcctgagccaaaaaactttgaagcctatcgagaattagcaccaatatttatccgattatctcgtcaattgcagacagaatatcaaaatattgctaattatcaaaggaagcattcaaaatagtttagtaaatagttactgagtatgagtggggaagaatgtatttgtaaatgaaaaggagataacggtcagagaccgttaatgcaagtagatggaatttgttatgttgattgtgtcaattttgattttgcttattttgattgcaaagttaaagttaaatacatttgtttcactaattattactgcttttattcttgccttgttgcttggcatgaagcccatggagataccaagtgccgtacttggtagtgaaggagtaggaaatattcttggtccaaactcggtaatctttatttttggtggtatgattggtcgcttagtcgctgatgcaggtggatcataccgtattgccaaaacattgattgattggtttggtgttaagcgtctgcagtgggcagtattgatcgcatcgtttattattggtatctcaatgatttttggtgttggcatggtgttgttaattccaatcgtatttgctgttgctattgaagctggtgtgccattgctttacttaggtatctcaatgacagctgccttaagttcggcacaaggatttttgccaccacagccggcgccaacagctgttgcctcagctttaggtgctaatattggaatgatgttgatttttggtttgattgtatcagtaattactgcagttgtggccggcccagcatttacaaaattagcacaaaaatatgcaccagatgcttttcaatttaaaacagaaattgaagcagttggacccgcaaaaaagtatgacttggatgcgacaccaaagttcggtttgtccgtactaacttctgtctttccattgatattcatgatcattgctacaatttataagttaatttacacaggtggtgtaacgccaaagaacccaaatacaattgatcaaattgttgagtttgtggctaatcctgcagtagctatgacaatcgcactagtttttgctatttttacaatgggtatttggcaaaagaaaacaatggttgaagtaggaaaatcattgaacgaaggaatgtcagctgttgctggaattttgttaattgttggtggtggtggcgccttgcgtggtgtcttggttacttcggggttgtctgacaagattgcgacgattttccaagctggtggtgccatgagcccaattgctattgtgttgtttgcttgggctgttgcggcagtcttacgagtttcagttggttcagctacagtggctggtatgactgcggcggggattgttacgggtattttagccgccaatcctggtaacacattattgccagtattcgtagcgttagctattggtgccgggtcattaatagcttcacacgtgaacgatgcaggattttggatttttaaagaatttttcgacttatcagttaagcagacattccaaatttggactgttttggaaacaattatttccgtaactggtttgattattattttaattttaacgtcagtatttgcttaaattaaaaatgctattccgattggaatagcatttttaatttggaaaggtggtaagtaacagatttattctattaaactttatcgaaacgctattttattatcaaaatccaactaaaataataatttgattggcataatcattccttatatgggaaacgttgacaataaaattagaaaatgttaatatattaaagtaacttttatagagttgaagggataaacatatgtcagaatcaaaaacaagaacagggtggctacataaagcgactcctgctagttttaccactagtgatcgacatctacgtaagacgttaggtgttaaagaaatgttagctttaggtattgggactatcgtatctacagctatctttaccttaccaggtattgttgcagctaaccatgctggaccagcggttgcaatttcattcgtaattgcggcaattgtttcaggacttgctgcgtttgcttatgcggagtttgcttcggcattaccatttgccggatctgcttattcttgggcaaacgttgtctttggtgaagtatttggctggattgccggttgggcacttttggcggaatatttcatcgctgtcgctttcgtggcttcagggtggtcagcaaacttcaaattattccttggctcacataacttagtattgccaaaggctttggctggttcatttgctgctggaaatggcggtgtcattgacatagcttcactatttgcggtgttgattgtcgcagtattgctatggcgcggaacaaacacgacggctcgtgttgaaaatgtgctggttgttggtaaagtattagttatcttaatctttattggtgttggtttaacagctattcaccctggtaattatgtaccatttatacctgctcataaggcaggcactgattttggtggttggtcgggtatattcgcaggtgcttcacaaattttcttagcctacattggatttgattcaattgctgctagttcagctgaagcaaaggatcccaaaaagaccatgcctcgaggtatcattggttcattaattgtagcaacaatccttttcgtgacagtagcgcttgtattagttggtatgttccactatacagagtataaagacaatgccgctcctgctgcctgggcattattgcactcaggtcatgaatttacatctaatttgttatcagtggttgccttaatcggtatgtttacagcaattattggtatgatgctggctggttcacgattgctttacgccttcggtcgtgacggtttgttaccaagtttcttaggaaaagttaatgataaaggattacctaacaacgctttgttagtattgtcagtcattgctatcttgattggatcagtatttagctttactgaattagctggtttgatctctgccggtacattgattgcctttatcattgtttctcttggtatttatgcattacgtcctcgtgaaggtaaagatatacaagaacctggcttcaaaatgccattttacccagtgatgccagcattggccgcattgggatctggatttattttctatgagttggataatcaagcaaagatttatgcctttggttggtttgtggtcggtataatcatttatgccgtttacggttctaagcatagtaagttgtctcaaaaataatctaacaaaaagtcctgaatttacagggcttttcttgtatataaatctaaaaataaatgtgaaagctgctaaaaatgtcaaaaaataaagagattttagaagaagaaaaaattcacttggcaaatgcaacgcgggttaaatattttgatattgtcattgatcacggaaaaggagccatcgttacggatgcagatgggcatgactatattgacttattggctagtgcaagtgccactaatacaggtcattcacatccaaaggttgtggaagcaattactagccaagctcaaaaattaattcagtatacgcctgcatattttgctaacacggtgactgcaaaattagctgatcgcttagtgaatgtagcaccagggaacttccaaaaacaagttgcttttggtaattcgggatcggatgcaaacgatgcgattatcaagtttgcccgtggatatactgggcgacaatatgttgtcagttttacgggtgcttatcacggctctacatatggttcgctttctatctcaggagtcagcttgaatatgactcgaaaaattgggccactattgccaaacacggtgaaagtaccttttcctgatcagacgcaacgaatagccggagaaagcgacaatgatttttccgaacgtttatttaaacagtttaaattaccatttgagacttatttaccagcagatgaagtggcgttagttattattgaacctattcaaggtgatggtggaattatcaaagcaccacaacattatgttgaattggtttatgagtttacacgtgaacatggcattgtttttgctgtcgatgaggttaatcaaggccttggacgaactggtaaaatgtggtcaattgatcattttgggattgccccagatttaatgagtgttggtaaatcgattgccagtggattgcctttaagtgcagttattgggcgcaaagaaattatggacagtctgcaagcaccagctaatgtttacacgaccgctggtaacccagtaacagcagcggcagcgctagcaacgctagacgttattgaagaggagaacttagttgcacgttctcgacaactgggtgagttggctaaagcattctttgagtctgctgctaaacgttatgcctttattggagacgtccgtttatatggtttgaatggtggtattgatattatcaatgatcatggtgaagctgataatgaggcaactaataagttaatttatcgtatttttgagttaggggcgattatgattagcctaagaggaaacaccttgcgttttcaacccccactagttattcgagaagaggagttgcagcgcgcctttgaaatattagaaaaagcattttctgatttagcgtcgggtaaaattgcattaccaaaaactgataatcacattggttggtaatatgatataatgattaagaattctggacatacgaattagccgtccgtcagttagaaatgtgctgggtgatgaaaagcacacgttggcttttttgcgctaccagacttaattgtgattgaaaaatcaccgctgctcagcgttatgagacataaaggtaaagattttattcaagatcattacaaattgcggtggtaccacggtagagcgtccgcactttgttttggtctttttatattatttaaggagaaaattttttatgaaagacttgagttcagcagaaattcgccaaatgtttttagatttttttgcttcgaagggtcacgaagttgtaccttcaaaaaatctaattccgcaagatgatccaacattgttatggattaattccggtgttgcgactttaaaaaaatattttgatggtacagtggtcccaaataatccacgtatcaccaattctcaaaaggcaattcgtaccaatgatatcgaaaacgttggaaaaacagctcgacatcatacactttttgaaatgatgggcaacttttcaattggtgattattttaaagaacaagcaattccttgggcttgggagttattgactagtcctgagtggtatggcttagatgctgaaaaattgtatgtaactgtgtatcctaaagatcaggaagccagaaaaatttgggaagaaaaaactagcttgccggatggtcacatttatgaagttgaagacaacttttgggacattggggagggaccttctggccctgattctgaaatattctttgatcgtggcagttcatttcaagatttacctgatgatgatccagaaatgtatccgggtggtgaaaatgaacgttatctagaaatttggaatcttgttttctctcaatttaatcatttaccaggattaacagataattcacaataccctgagttaccgcacaaaaacattgatactggtatggggcttgaacgtgtcgtatctgttttccaaaatggccgcactaactttgatacagacttgtttttacctatcattcgggccacagagaaattatcaaatcaatttacctatgatgatagccaagattcagaggtcaatacgagctttaaagtaattgccgaccatattcgtgcaataacgtttgcaattggggatggggctttgccttcaaacgagggacgtggatatgttattcgtcgcttgttgcgtcgcgcagttttgcatggacaaaaattaggcattaaaggacagtttttaactaacttggtaccaattgttggggacatcatggaaagctactacccagaagttaaagccaacactgccaagattcaaaagactgttgctgctgaagaaaagcgttttaatgcaacattaacaggcggactttctttgttgaatgatgtgattaaagaagctaaaaagacgggtcagacacaaattagtggtgccgatgccttcaaattatctgatacttatggattcccacttgagttgacgcaagagcaagctgaagatgctgggttgacagtggatgtggatggatacaatgatgagttgcaagcgcaacgcgttcgcgctcgtgctgcacgctctaatactaagtcaatgggcgttcaaaatgctgtattaactgatttgcgtgtcgattcaaagtatgtcggttggtcccaaactgaagtcaatcatgcggaaatcgttgctattattggcgaagatgaacaaggtgttgatgcgctattggataatgctgatgttgatgctaccgtacaagtagcctttgatgtaacacctttttatgccgaaatgggtggacaagtgcctgactttggtgatgttttgaacaccaatggagatgtgattgctcatgtgacagatgttcaaacagctccaaacggacaacatattcatactgttgatgtcatttcaagctttactcttggtgataaagtagatttgaaggttgatatggcacgtcatatcgccgtatccaaaaaccatacagcaacgcatatgttagaccaatcattacgtaatgtacttggcggtgatgttcatcaggcgggttcattagtagaaccggaatatttaaggtttgatttcaataatgagggacccgtttcaagcgaagatcttgataaaatagaatcgatgatgaatcaagaaattgctaagaacctaccggttacttggttagaaactgacattgagtctgcgaaaaaattaggtgcagttgccgtatttggtgagaaatatggtgatcaggtccgtgttgtatccattggtgacttcaacaaagagtttgatggcggtactcatgctaactcaaccgcagagttaggtctgtttaaaatagttagtgaatcaggaattggtgcaggggtacgccgtattgaagcggtaactggtctacaagcactttcacaatataaggctcaggaaaaagctttgaaggaaatagctactgctttgaaagcacaaaaactgaccgatgctccggagaaagtatatgatttgcaagctgatttacgtacggtacagcgccatgccgaatcattagaagctaaattagctaatgctacagcaggtgaaatatttaatgatgtaaaaactgtcaatggacatacttatattactgcccagttacaggtttctggcatggatggcttacgacaagttgcggataactggaaagaaaattatccatcagatgttttggtactagcaaccgttgctgatgaaaaagtaagtttgattgttgctgctgctccagatgctaatcaatcgggcattaaggccggcgaactcattaaatctattgcaccacacataggtggcggtggcggtggacgtccggatatggctcaagctggtgggaaaaagcctgcaggtattccagatgcatttgccgcagtttcggcattcttagcagataagtaacttgtttgtaacttgattgatgtgattatagcgtagtataatgagtgaataaacaaggcagtatggagataatttctaaagaaaggagcgtgtactatgacagtaggagatgaaacagcaatatttgattttggtaatcaaatgccaaaagatatccatgaaacacttgagattgtgtatagttcattggaagaaaaagggtataatccaattaatcaaatagttggttacttgatgtctggcgatccggcctatattccacgtttaaatgacgcacgtaatttaattaaacgtcatgaacgcgatgaaatcattgaagaacttgtacacgcctatttgaaaaaataatgcgcatattaggactagatgttggtagtcgaacagttggtgtatcggttagtgatccgatggggtggacagcgcaaggtgttgaaatcatccgcatcaacgaggatgataaagaatttggcattgatcgattgggagagatcatcaaagagaaaaacgcaacaggtgttgttcttggtttgccaaaaaacatgaataatagtgagggaccacgtgcggaagcatcccgaaactatgcaaagttgattgaggaaacctttggtttaccaactgattttcaggatgaacggttaactacggtagaagctgagcgtatgctcattgaagaagctaatatatcacgtaaaaagcgaaaaaaagttatcgataaaatagctgctgaatttattttacaaaattatttagattcgaaaggcaagttaaccaagtagaataaaagccttgtccctatacggaacaaggcttttattgtataatgaacttatgacatttgataaggaaaagaaaatgagcgaaaataacgcagaagtacaaaaaattacgttaattgatgaaagtggcgatgaagcattatatgaagtgttattcacattccattcagatgagtacaataaagactatattttgttagtaccagaaggtattgaagatgatgaagaagttgatattcaagcatacattttcaaccccgatgaaaacggcgatgctacagaagaagaattaattcaaattgaagatgataaagaatgggatatggttgaagaagttttgaatactttccttgaagacgattcaaattttaattaatagtgtgcattaataataaatactgatattcatgattcaaacatcatgggtatttttattttgtgttaaaaaggggcaaattactttcaacgtagcttatcaagtgataaactagaaaaggtagaaactacttagtttagagttagtttaaatatttgaggtagacatgtcgaaattttgatcgtgtcttttggaggaattattatggttacgttagtgggcatacttgatttagcgcgttttcagtttgcgatgaccacgatttttcattttttctttgtaccgatgtcaattggtttagcagttgtcgttgcatcaatggaaacaatgtatgtgattaagaaggaagaagtgtataagaaaatggcccaattttggagcaaaattttcttacttagcttcgccgttggtgtggtaacgggtattattcaagaatttcagtttggtatgaattggtcggcatattcacgttatgtaggtgacatttttggggcaccattagcaatagaagcgctcgttgctttctttgctgaatcaaccttcattggtttatggtcatttacctgggaccgttttaaaccggcaattcatgtcatttttatttggattgtagccattgcctctagcctatcagcgttatggattttggccgctaactcatttatgcaaaatcctgttgggtatgccattgataataatatggggcgtgcagagctgacaagtatttttgcattaatgacaaatcaacagctatggattgaatttccgcacgttttgatggggacttttgttgccggtggctttatcattgcaggaatgtctgcatttaagttgttgaagcttaaaaaagatgatgtgcaggttgattttttccgtaagtccattaatattgctttagttgttggtttgattggtgttggtggtacggtaattaccggggatcgtcatgcttttgagttgcagtctatgcaaccaatgaagtacgctgctatggaaggcgttgatgagacaatggattcgtcaaaacgcgctgataaagcacagccttggtcattgttatctgttactaatccgaaaacacataaagtaatcgcaagaattgaggtaccatacgtactatcaattctaggaaatcattccttaactggtggcacaactgtagggacaactgagttaaacaagcaatttgaaaaaaaatatggaaaaacacatgatggcattaaagattactatgtgccagaaaatacgttattctatgctttccgtgtgatggcagttggcgccggattattaggtatggtggctcttgtagcgctttggttcaatcgtagaaaaacgaatttaattttgactcagcgttggttcttatggattctaggaatcatgacgttcttcccatttgttgtgaataccgcgggatggttggtaacagaattaggacgttatccttgggttgtatatggattaatgacaatcgctgatgctgtatcaccgaatgtttctgccgcttcgttactcatttcaaatatagtttacttcttaaccttcgcgtcacttggtggcgttatgatctggttgtctcgtcgtgtgttgcacgatggacctgatgcagaaaaagaggaagagctatcaccacgtgatccatatgaggatttagcaggaagtgaggaggcagcaagatgagtttcttacaaattttatggtttgttttgattgccatattatggtcaggattcttctttttagaaggctatgattttggcattggcatgcagtttattttcaattcccgtaatcaagatgatcgagaagcgctgtatgaatctatcggacctcattgggatgccaatgaagtttggttaattactgcgggtggcgcaatgtttgcagctttcccttattggtacgcatcactgttttcaggattttacttactattgttcattgtactgatggcattgatttatcgcggtgtttcctttgaatttcgtgaacatatgcctaccattcaggggtcacagttgtgggaacgtttcattgcaattagctcgtttatcgcaccatttttcttaggaatgatttttactgcaatggtatcaggtatgccaatggatgctaagggaaacttgtcggctggatttttcgattatgtaacaccatttacgcttgtgggcggtattgctgtcacattaatgagttatgtacatggcttgaattatacacgactgcgtattatcggtgatattcgcacaagagcaatggcacaattgaaagttctatatccaattttgttggctggagaagcactatttgcaattctgctgttcttctacacggattttttccaaactaaattgttatggacattaattatactagtggcaattgtcctatccacagttattggttggtatttaacggttaataagaaaaaagaagtgttcccatttattttatctggtttgactttggttgaagtcgttatcttaatattcgttggcctattcccacgtttaatggtagctaacaatccgttacacagtttaaaaattattaatgcatcgtcatcgccatatacattaaaagtgatgtcatttgttgtattaacagctttaccattgacattaggatatcaaatatggagtttctgggttttccgtaagcgtattgtagctgataaggtagttgaataataattctaaaaacgtttacaattgattgtaggcgtttttttatttaaggagagtgtttggcagggtattgttatagagataacaaaccattgtttaacacatataaaaaatatgatagataaaagactttttgcgttaccaggtattattagttctttggtaatcttagttattttgacaggaattcaagcattttcgattatattccagggagttttcttggcccgagcaattgctgatttatggcaaggtaaaagcattgaccaaacactcattaatgtattgttttttgcgttttcttttttgatgagacaactattgattgtgttaaaaaataactatatgtcgaaatttgctgatcgtacagtggaaaattatcgtattcaattgttggctaagtatgccgaaattggccctagtattattaaacaatcgggtacaggaaatgcggttacaacactaggtgcgggattggataatgttaaaaactattttcaactactactgattaaagtttttgatttgagtattattccttggttaattctgctatatattgtttatcttaagtgggaacagggactatttttattgctagtatttccagtggttatattgtttttcatcattttgggcttggcagcacaaagtaaagctgatgcagagttcgctaattttaagaacttaaataatcgttttgtagatgctttacgaggcctgccaaccttgaagcaactaggtttatcgcaatcatatggtgacgaaatttataatatttcagaagattatcgaaaaacaaccatgcgaacgctgagaattgcgattacatcaacatttgcgcttgatttttttacgactttatcagttgcaattgttgctgtgtttttaggaatggatttaatgaacgccaaaatggcacttttcccagcgttgacaattttgattttagcgccagaatattttcttcctttgcgtaattttgctgatgattatcacgcaactttgaatggtaaaaattcactaactgatgttttggaagtaattgataccaaaattgtcggtccacaagatgaacttcaattaaataaatggcaagcagagagtgaattgtcattgaacgctgtgcagttttcttatgactcaaaagtcaccttgaaagatatttcgttgcacgctaaagggtatcaaaaaattgctttggttggggaaagtggttctggtaaatctacactactaagtattttgggaggcttcttacaacctgaacaaggaacgataaatatcaatggacaggagatcaaatatttaacacaacagcaatggcagaagcagtttttttatatgccacaaacaccttatatttttcatgaatcgttacgtgataatattaggttttacgcaccaagtgctagtgacgaagcaatcaatgaagctgttgaaaaagcaggtttatccagtttgattgatgaattgccagcagggttgaatacaataattggtgagagtgggcgtcaactatctggcgggcaggcgcagcgtgtagccttagcaagaatgttgctagattcatctcgtaaagtgctcctttttgatgaaccaacggctcatttagatattgaaactgaaattgatttaaagagaacgatgtcaactatcttggataagcacttagttttttttgcaacacaccggttacactggttagatcaaatggatttagttattgtgatacgtgacgggcgcattgtggaaactggcgtgcctggtgtcttactagctgataccaatagtgctttgaatgcgctgcgtcatgaattacataaaggtggtctgaaatgaagcgattgaaaaaattattgtcacaagatagatggattcttccgtccttaagtcaacaaaaatctggccttttttggtcgatatttttgaattttatgattacttttgccgctggtgcattaatgtttgtatccggatttctaatttctcgttctgcgcaacatccttctaatattctcattatttatgttccaattgtgctgacacgtgcatttggcattgcgcgtccagtttttcgttatgcacagcgtttggtgtcacacaattgggtattacgtgtcgtttcgaaaacacgtaagcgtttatacgaaagtgcggccagcacggctagcagtattcgaggacaactgcaaacaggtgaagtacttagtttacttgctgacgatttagaccgtttacaaaatctctaccttagaacgctttttccattaggttcaggtatggtattgtacctttttctcacaatagcaattggcacaattaattggttattcatgttgtggtggtttgttatgttggctgttatcttggttattgtgccattattgagtttggcagtgaactataaaggtgtgcaacaacaaaagaaattacagcaaagtctttatatagatgcaaccgatgctattttaggtttgcaagattgggtgctatcaggacgacaagaagatttagtacaaaatcaaggcgaaacaatgtcaagattagctcatgttaagaaccaaagtatgaaatttggctggtggcgtgattttgtcattcaagttttagtattgatattgactataacaaccttaatgtgggcaaccaatcagttttctgatagttcaagtacagttaattatattgcggctttcacacttgcaatatttcctctaattgatagctttattgctgtgaatcaaggtgtaagtgaatcctcattctacgaagatagcattgtgcggttaaatgatttaccagaaccaaccttgctacaggagactagacacacaactaactcagcagtaattaattttaatcaagtcacatttaagtatggggacaaaacaattgttgataatttgtcatttgaagttcagcctaaagaaaaaattgcgttacttggtcgttcaggcgcaggaaaaacaactttattaaagcttttggcaggtgatatccaatcatctttgggtgaagtaacaatcgatgaaacgccagtccagaacttacaagggagtatgtctagtttggtggctgtgttggatcaacaggcgtatttatttgatacaacgattatgaacaacgtgcgtatgggaaatattcatgccactgatgagcaagttcaaaaagcaattaagcaagctgggttacagccattaatcaattccttacccaacggatactatacacaaatgcaggaagcaggaacacgcttttctggtggagaacggcaaagatttgccttagcacgaatcatgctgcaagatgcgccaattgtggtgctagatgaaccaacagtatcactagatcccaaaacagagtacgaggttttatcccaaatattttcagttctcaaagatcgaacgattatttgggtcacacatcatttgacaggaatcgaaaatgttgataaagtttactttttagagaatggaaaattcacgttgagcggttcaccggctgaattgcatcaaacttcagcaagatttaaacaattattactcatggatcaatattaatggcgaaaaaaaagcgaagaagatcaaaaaaaggattacaaaaacagcgattgcgtatgttgtgtggcttgttagttgcattggttattttagccgccgtcacatccaacactgcgatttatgaaagacctcaaaacaatcagatcaatacaaacagtgaagaagcaaagaaggtggcttggattaatgaactagcgccatatgctcgtgaactgcaagaaaaatatggggtcctggcatcaattagcattgcgcaagctatcttagagtctgactggcacacaagtacgttatcaacaaagtataataatctatatggcattaaagcggatgcaggacaaaaaagtgctgtattaccaacgcaagagtatgttaatggtgaatggatcaccattcaaggacgttttgcggcttatgatagttggcaagaaagtatgaaagcacatgcaaaactattgcatgatggtacgagttggaatgcaaaacaatatcaacacgtcttggatgcagatgattacgcttcggctgccaaagcattaacacaggatggttacgcgacggatcctaattacgctaaaaagttaattacaattattcaaacttggcatttggaaagatttgatgcaacaaaaaagtagacgttagtctactttttttgtttttaaaatgtaaattcatgcgggaaaatacccatcattaaactgtcatggtattctccttcagcaaaaaaatgttgacggagagtaccttcaggaatgaaaccaatttttttataaatgtgaatagctgccgaattattcacatcaacatacaagtaaactttatgcatattcagtactgtgaaggcatactctattcctgctctcatagcagcctgtgcgtaaccatgaccttggaactctgaatggataatgatttgaatttctgtgtgtctgtgtagcgtatcgatatccattaattcaacaacaccgataaaacgatcgttctcttccacaacaaaacgacgttcagtttgatctaaaatatgacgatcgtaaagaatttgtaattcatcaaaagatgtataaggttcttcaaaccataatgccatcaccttacgtgaattttcttgttcgtaaatataagggagatctcttttttcaagtggtcttaatttcatagaatgcttctttccttcaatatgcttttactggtgattatgcttattattttatcattgattatgagggacgtgtgcgtaaaaatgttagaatgacaatggaagcatgttcggaagagccattagagttattacatgaaaaatggtaaaataaaggaagttatttttacaagtaaggacataaaaatgccaattgaaaccctaattcaaggaatgaatgataaacagtcagaggctgttcaaaccactgaaggaccattattgattatggctggcgctggttctggtaagactcgcgttttgacacatcgtattgcccatttggtgcaagataaaaatgtatacccatggcgtattttggcaattacatttaccaacaaggctgctcgtgaaatgcgtgaacgtattgcacaactagttgatccagaaattgcaagagaaatttgggtctcaacatttcacgctatggccgtgcgaattttacgtcgagatggcgagagaattggcctagcacgtaattttacaattatcgatacaagtgcccaacgcacgttaatgaagcgggttattaacgatctgaacttagatactaatcaatatgacccacgcacaattttaggcacagtttccaatgctaagaatgatatgttgacagctaaggcttatgctaagcaggctggtaatgtatatgaggaaactgtcgctgaagtgtatgccgcatatcaagcagagctacgtcgcgctcagagcgttgattttgatgacctaattatgtctacgattgatctattcaaacaagcgccagacgttctggaacgataccaaaatcagtttgaatacctgcatgttgacgaatatcaagataccaatgatgcgcaatatacgattgttaacttactagcgaaacgttcacgtaatttagctgttgtaggtgatgcagatcagtctatttatggttggcgtggggctaacatgaataatattttaaacttcgaaaaagactatccagacgctcacacagttttgcttgaacaaaactatcgttcaacccaaaatattttagatgcagcgaatgcagttatcaataataataatgagcgcatcgacaaaagcctttggactgaaaatggcaaaggcgataagattacttattatcgcgcgcaaacagaacgtgacgaagctaactttgtcttggccaacattcaaaaatcacgccaagagaagaatgcagcatacagtgattttgcagtattatatcgtacgaacgcgcagtcacgtggtattgaagaagcacttgtgaaagctaatatgccatacaccatggttggtggacataagttctatgagcgtaaagaaattcttgatatcatgtcatacatgaatctgatgacaaatcctgctgataatgcggcgtttgaacgagtagttaatgaacctaaacgtggtattggtgcaacatcgattaatcggttacgggattttgccaatcgaatgaatttgtcttatatgggcgcaattgaaaatattgaattagcaccagaaattacagctaaggcagcttcaaaattaattcagtttgctgaaatgatgcacaatttgcgtcaacagactgagtttttaactgtgaccgaacttgctgaattagcgatgacaaaatctggctatcgtcaaaagctagccgaaaaaaatgatcctgaaagtcaaggtcgtctagaaaacttggaagaatttttgtcagttacaaaggaattcgacttaaaatacaatccagacgattccgaatccgttgatccgatgactgattttttgagttcaactgcactaatgagtgatttggatgattttgaagaaggtgacggggcagttaccttaatgactttacacgcagctaaaggattggagtttcctgttgtctttttagttggtatggaggaaggtatttttcctttgtcacgggctatgatggatgatgaccaactggaagaagaacgtcgtttggcttatgttggtattacacgagcgatgaaaaaattatatctaactaatgctttttcacgcttattgtatggtcgcacgcaagcaaatgaaccttcgaggtttattgatgaaatttcaagcgagttattggatacacaatatggtggtatctcttcttcatcaaatgatcgatcttttccatttgataagaaaatgcaacgagcaacagccacaacctataaggcggccagcccagtaaccaaaataacttcaggaacaaccggtgctgatagtacggtttggcagcctggtgataaggtgtctcataaaaaatggggaattggtacgattgtttctgtgtcgggatctgcacaagatcaagaattaaaagttgctttcccatcagaaggggtaaagcagctattagccgcttttgcaccaattaaacgagcagaatgacaacgctaattattatacgtggcaattctggtagcggtaaaacaacattagcccatcaattacatcgtgttttaccagatagcctactcatatctcaagatattgttcgtcgggaaatgctcaatgttaaggatcaggtgggtaacttatcgatatcgctaatcgaacagttacttgagtttggtaatcaacaagaacagtttgtgatactagagggcattttgaaaaatagtgtttatggtccaatgatacgtaagcaaatccaatattttagtcaagtggttactgtttattaccaattatccttgaacgagacagttcggcgccattgcactaagcaagtcactgactttactcctaatgatttaactcgttggtatcaaagggatgactcacttcgcatagaaggtgaaatgatttttgatgagtctgtgagtttgatgatggcggaaaaacaaatacttactaaaataaataaatattgaggtcgagaatgttaccagattttacgccaattgaaaaattaacaacacaagacgcgcaacaagaaaccgcgcgattacaaaagcagcttgtgcaatatggcacggcttattatgaagatgacgcgccactagttgaggactacatttacgatgcattatatgcgcggttagttgcgttagaagaaaaatttccacaatatgtgattccagattcaccaacacagaatgttggtagcgcagatacaaagtctgaattacaaaaagtggtacatcctgccccaatgctgtcgttaggtgatgtatttagcttagacgaacttaacgactgggatgcaagaacaaccaagtcgcttggaaaccaagcaccttataatttagagttaaaaattgatggcttagcagttgcattgacctacgttgacgggcaactagtacaagcttctacgcgtggaaatggtatcgttggtgaagatgttacagcgaatgtgaaaacaattaaagcaataccaaaaaaactgactgaaccattaaccattgaggtacgtggcgaaatttatatgccaaaagctagttttgctgctctaaataagcagcgagaggctgatggtttagaaccttttgctaatcctcgtaatgctgcagccggttccttacgtcaattgaacgttaaaattactaagtcacgaaacctagcggcttttgtatactatacggctgaacctgaaatgctaggagtgacaactcaaagtggtgcgttagaacgatttgcagaattaggtttgccaacagacacacacaatcgtgtcatcaataaaatggccgatattgctggctatattgatgagtatacttcggagcgcgaaagcttgtcttatggtatcgatggtgttgttgttaaagtgaatcaactagacttacagtttgatttagggaatacagttaaaatcccacgttgggctatcgcttataaatttcctccggaagaagctttgacaatcgttcgtgacattgaatggactgttggacgaactggggcggtaacacctactgcagttatggaccccgttttgctagcgggtacaactgtgcaacgtgctagtttgcataatcctgattatttaagggaaaaggatattcaaattggtgatacggttacgctacacaaagcgggtgatatcattccagaaattgggcaagtcattttagaaaaacgtccgacagatagtgaaacttatcaggttccgacaatatgtcctgcctgtgaatcaaatttagttcacattgaaggtgaagtagcactccgctgtattaatccattctgttcagctcaaattcaagaaggactaacacattttgcgtcaagaaatgcaatgaatattgatggcatgggaccaagagttgtcggtcaactactaaaggcaggctatattaaagatgtggcgtccatttaccgcataacggttgaacaattactaactttagacaagttccaagagaaatcagctgtgaagttaattgatgcaattaacagttcaaaggaaaattctcttgaacgcttattatttggcttagggattcgcatggttggtgcaaaagcggctcgactgatagcagaaaagttcaggaccttatcagctgtttcagaagcctctgttgaagacatcgcaaatattaatggtattggtcacacgattgcccagtcaattgttcaatactttagtacgccagaatctaagcaactacttgtcgaactagcttcttccggtgttaaccaatcatatttatctgatacagtgattgacgaaaattcatttttctatggcaaaaaggtagtcttaactggtaaactagaacagagtagtcgacctgctgcaacaaaatggttgcaagatcatggggctaacgtcgccggatcagtgtcagtgaaaacagacttagttattgcaggagaagctgcaggtagcaaacttgataaagctagtcaattaggtgttacagtttggaccgaacaacagtttgttgatgaacaagtaaaagaggacggaaaataatgaagcggattggttttcgtggttatatagcgattgtcgttggtattttgattatcgccgttggcattttatattttttcaatgtgaatcgtgtcacactaacaacaagtaaaaaaacaagtggtgtccagttgactcagagcacaccaggtcagtaccaaacggtgatcaaaaatggtcgttatttggtgagtgcagctcgtggtattacgtcaacttctgagacgaatagtcttgatgtgaaaaactttgaatcatcattgcttgatttggctaaaacacattttaagacgagcagttatatttttcaagagggacaatatttgagttcgtctactgttacttcattacttgagcgtaaaaatagcagtaatagtgatggattaaatcctgaagataatggtaagacagatagttcacgtaatccgatttacgttcaaacactaaccgaacaagatttcatgaccaaagatggtgacgaccttaaattagctggtatggttatcggcgtagcgatgaacacacaggatgaataccaaaaagaacaatatggtgctacatatacacaaaacatttcagatgctgatcgcatagcttatggtaaaaaaattgcaccagaaattatcaaaaaagtgcgagaacaaaaaggggttgattcagatacgcctattgtgattgccatgtatgccaattcaaaaacagattcattagcgccagggaatttttatgcagagtctacaagtagtagcggaactgacttgaaagaatggactagcattaatcaaaagtctattgttttgcctaaggaatcaactgatacatcaagcttgggttcagaggctaacacatcttttgctaactttaaaaatgatgtttcaaatttctttcccaatatagctggtgctacggcagttgctaattttaagtcaggtacgctttctagtatgaaagttacagtgacgacacagttctacagtcaaactgagattgaaagttttgcgacatatgtatctcaatcggcgttaaagtatttaccaacgaatgtaccgattcgaataattattaaagccgccaatgaaatgcaagcaattctaatccgtaattcaggtgacaaaacatttacgacaacaatattagactaaaaaaatcgaccaacttggtcgatttttttatagcttgttaatataaatactgttaatccatcctttagtagctattttataccaaacaatgttattatcatcgtgaatttcttccgttattgccacaaaatcactatcggaaacactaccgattggcaacccataaggttcagcatagacttctatagatcgatcgggaaggaaattaacaaccgcgttaggctgattacttttacttttttctgcatcattaaaatagttaatattttcaacttctggagctgtgtctgacaatttcatttgggtagcatcataacgaatccaatgatagtcaccaatttgataccaaaattgaccattaccagaaatagcgcgtaattgagttgcccaaaaagtatttgggtttaagtttgtcctaacgtttgataaattatctggctctagaaaaacttgtacgctggttactgtttcgataaacatgttaatacggtgtacagcttgccattcttgtggccgataataaagctctaatgactgaggtaggctaccaaacaatcccgtcaaagatcctgaagtatcgatatactgataattggcgatatctaaaattgcgatttcgtaaggtgcgcctgcttcgccatctaatcttgttggttcgtgtaactcatcaccagttgctatatttttataataaacccatacgggcgatgtatttgccataatatcccctttgaatatacctacatattatatcacaaacaaaaaacgacccgaaagtcgtttcatatcacacgtaagttaaattttatttacagtaactggttctggcttaacttcactaataacaaattcattatgaacaatgtcagcttgcaaatgatgaacatctgggtgttctaaatagaaatcggcgataccatcggcgattttatcttgcatgacacgacggagaggtcgagcacccattgcagggtcataaccgagctccactaatttctgcttagcagcagtgcttaaatcaatgtgcaaatcgttgtcagacaagttatcattcatatcagtcaataacaagtcgacaatttttagtagatgatcttgtgacaaaggttggaaatcaatgatatcgtctaaacggttcaagaactctggacggaaataattttccaaacgttgcatcaaacgattttgttgatcaacttgggcgaatcccacaggtgtatttcctgtgtctgttgaaccagcgttagaagtcataataatgacagtatctttgaaactcactatgtgaccttgtgcatcagttagacggccatcatcaagaatctgtaagaacatgttcattacatctggatgtgctttttctacttcatcaaagagcaccagtgagtagggacgacggcgaacttgttctgttaattgaccagcctcttcgtaaccgacataaccggcaggagcaccaatcattttagaaacggtatgtttttccatgtactctgacatgtcgaaacgaaccattgcatctttgctaccaaacatttccttagctaattgcttggcagtttcagttttaccaacaccggtcggcccgacaaataggaatgatccaattggacgaccagattttgttagaccaatacgattacggcgaatcgccttggctagtttttctactgcctcatcttgaccaataacatgtttcgataagtttttgtccaaatcttttagttgattagcctcgttttcttttaaagctccgaccggaatatcagttttatcttcaacaatttttaatatatcttgctctgttactgtttgtggcttcgacatttcggggtgagcctcgacttgtgccttttgtgactcaagttggtttacctgatcacgccaatagcttgctttttcaaaatcttctttatcaattgcttcttgctttaatttatcagctgcttcgatattcacttgaatagttttggggtccgcaactttcattgtcaaatttttacgtgagccagcttcatcaagtaaatcaattgctttatccggtaggaatctttctggaatgtaacgatcagatagttcaacagctgcttgaagggcagaatcactgaacgtaacatagtgatacttttcataccgttcactaattccttctaaaatcgtgatagtttcttctttagaaggttcttcgacttgcactggctggaaacgacgggcaatagcaccatctttttcaatttttcgatactcatttaaagttgttgcaccgattaattggaactcaccacgagctagggcaggcttcaaaatattacctgcatccataccaccttcagcatttccggcacccataatttcatgaatttcatcaatgaacaagatgacatcatcgctgttcgtaacttctttcattaattcacgcatccgtgcttcgaattgaccacgcatgctcgtaccttgaactaaggccgacatttccaaacgaataacttctttatgctgtaacttttcaggcacctttccagccacaatagcttgcgctaggccttcaacaatagctgttttaccaacaccaggttcaccaattagtactggattattctttgtacgacgatttaaaatttcaattgtgcgagcaacttcgttatctcgaccaataacagggtcgagctttccgtcgcgagcttgtttggttaaattaataccaaactcatcaagtaagcgtctttttttattaccattattatttttttgtgcttgtgtattttgttgtccttgtgcttgcgccatttgttcattcattgcgcgaaacatttcatctaaattaccaaaaccaaacgaatcttgttgtgccatatcttttacttagtgtgaagcaccatggaatacagttattgcatttcaccatagtattgcacacgattcctttctgtaggttatgctttaattatagcacgatttaagaaaaatgcaattaaaattagcactcgttaaagtagagtgctaattttaaaaatgttatactgtctatgaggtgaattatggattatacacaagcattaaatgatttgcgtgatgggaaaatagacgaaattgaagtgacaccagcagtatttccggaatttcaaaaggcatgggcaaatttcgcatatcagaatactattcgtggtattgctcacgctcacggtaaagttacatatgttcgctcaaattgatgtgcgaattaaaccagttttatgctacaatattataagttaagtaaaatttaaatgtgttgcaattgcagtcgtaacacgataaggggcagtacagtggcattttcatttggacaaaaaaatgttggtatcgatctgggtaccgctaacacatatgtatatatcgaaggtcgtggcatcatattgcgtgaaccatcagtagttgcgcgtaatacacaaaccaatgaagtcgttgctgtaggttctgaagctaaagacatgttaggccgaacacctgcaagtatcgctgctattcgtccgatgcgtgacggtgttattgccgattatgatacaaccgttgcaatgattcgttactatttgcaaaaagcacttggcggacgtattggcaaaccttatgtaacgattggcgtaccttcaggtgtaacagctgttgaaagacgtgctgttattgatgctgctcgtgttgctggcgcgcgtgacgcttatgttatagaggagccttttgccgcagcggttggtgctgggttaccagttatggatcctactggatcaatggttgttgacatgggcggcggaacgactgatgttgcgacaatttcattaggtggaattgtttcaagccgttcaatccgtatagccggagacaagctggacgaagcaattgctaattttgttcgtaacaaatataatgttaccattggtgagccgacagctgaaagactcaaaatcgaaattggtgctgcatcactagctttagcacgtaccttaccaaatgctacagtcagaggtcgtgacttattgactggtttgcctaagacaattgatgttaccgctgaagatgtagccacatcaattcaagaaccagtgcaagaaatcgtggcagctattcgtgagacgttggaatcgactcaaccggagttagctgcagatgttattgatcacggtatgattttgaccggtggtggagcattattgcgcgacattgaaaaaattattcaggatgcaactaaggtaccagttttaatagctaacgagccattagatgcagttgctattggtactggtgaggcgttgaaatctattgatgtcatgcgacaaaagtaatggtagtttaaaatagcgtggcgcttgcgctacgctattatttattttcaagaattaatgtcaaataaaagtttctaagtaaaacaaggtagcataccattgaaagtagatgaaactgtcaactgtttttagaagtggtaactggctttttggggaaatacatgaaaaaaatattttcatcacgcacgttggtatcaataattgttgcgtttatagtaattgtaagtttaattgcaggatcaaattggtgggccaagagaacgaatacgccaccttttttacagcgttttgggaatgatttagcgggtggcgttagtcgtattattgctgttccaacgactgccgttgggcgtacagcaaatagtattagtaacctgttagatacatttgaagaaaacaagcggttgaaatctaagattgatgaatttgctcaagacaaggttcacctacaaacagttgaagaagagaacaaatctctgaagcaacaattaaaactaaaagccacattgacagactataaaacagtttcggctgtgaccattagtcgttcaccgacaacatggcagtcacaattagttattgatgaaggatccaattcaggtttgaaaaaagggatgccagtgcttgcaggtgccggaattattggccgtattagtgaagtaaacacaactaattcaaaagtggctttgatttctgatactagttccgatgccaatagatttgcgattaaaattaagggtgatgatggcgatgttaacggcattgtaacaagttttaaccgtgagaaaaatcaactgattatggggcaagttacgtcaaataataaaattagtaaaggtgatttagttgaaacttctggcctcggtggtgttattccagcaggattgtacgttggtaaggttgctagtgtcacgacggatgattatggtttatccaagaaaatatacattgaacctgcggctgatctaggtaatatcaccacagttatggttgcaatttcacagataggagcaaattaatggcattttggcaattgacgagattgcgtgtaatttatcctgtgttattatttttgatactgtttgttgatggaacattcatgtctagtatgggggggttatttacacaatttccttggcacattttacccactttgacacttggttggctctttttgggtgtccaatttgatgttgaaaacgagttacctttatggttttatgttgtggtcattggtatattgtttgatatgtactacactggtatttttggtacatatacttttgcatttattgccgcggtagctgtgatgaagcaactgcacaaagtgctagatgagcgtctagtaagtggcttgcttttatatttagctggcttgcttatttacctactaatttcttatgttagtggatttgttactggaattgctaatgttagtatattatcgtttttattgtacgaggtattgccaacagtaattttaaatctagtttttgcggctgtgtcatattatcccgtatggtctttatttcagtttctgcgttgacaagttatctttttatagtataattatgaccatatagtaaaacgttgagtagaagagtagttcattttaaatttagaagagaatttgcggttgctgtgagcaaatagttaaattgaacgaaacacatctatgagtataaagctgaacaaagtaagctttgtcggaagtgtccgttatcacataacagtctttgacttattgagatgctactagtgatagtagcataacaaagaggtggaaccgcgatgaaacgccctctaaatacatttcttgtatttggggcgtttttaattggttagaagactggtggagagcttttgtgtgagcaaaagttgaattcgaggtggaaccacgcttttgcgtcctcttacagtagaaatactgtaagaggattttttcgttttataaatacattataaatgtgattgttctttctcgtgaaaatatatgagttataagtgcaattcaacaaaggagtttcaattatgagttatctaactacaattcttcccagtttattggctggactaaaaacgacgctaggggtgttcttcctaacaatcattggatctgtaccattgggaattttagtatccttagggatgaaatcaccttactttacaatacgttggttgattaacggttatatctggattatgcgtggtacgccgttacttttacaattgatttttatctactatggtcttggaatgatgggtatagcatttccacgatttgaagctgctatcatagcgtttattatcaattatgcagcctatcttgctgaaattttccgtggtggactacaatcagtcccaagagggcaatatgatgctgctaaagtacttggctttagtaaaatacaaacattttttaaaataattttgccacaagtaatcaagattgtcgttccttcatttggtaatgaggtgattaacttggtcaaggacacttctttagtttatgttattggcttaggtgacatcttgcgagcagggaatattgcggctagtcgtgacgtgactttgatgccatatctattagttggattgatatatttgattatgacggcggttgtcacattattattgcgccgtagtgaaacagttttgaatacatggaggtaatttaatgttagaaatcaaaaacttaactaaaaaatacgatcaaaatgtgatctttaaatccttgaatttaacagtacatgatggtgaagtattaagcattgtcggcccatctggtattggtaaaacaaccttaattaaaattatggcaggattagaaactgcagacgatggcgaaattattttaaatggtgaaaacatcgatattacaagtgaaagctccgatacgaatattggcatgattttccaagattttaatctattcccaaactacacagtcattgacaatatcacgttagcacctattaatgttaataaacagtcttcatcgaaggccgttgaacaagggcaggagcttttggaatccttaggcatgttagataaagctaatttgtttccctatcaattatctggtggtcaaaagcagcgtgcagcaattgcacgtgcactggccatgaacccgaaaattttggcatatgatgaacctacaagtggattggatgaagcatcgacacaccaagtcgctgatgttgttaaaacgcttaagaaacgtggtgtaacacaagttattattacgcacgatcagccatttgctgaaatggtttctgatcgcgtgtttgattttgcaacggaggtaaaacgctaatgccaagcatgaaaaagaagattgttgttaatagtattgttggtattttatttatcgcactggtcgttatggcagctctctctttatctaataattcccaaaaaagcaaaagtacagaacagacagtagtgaaaacagatcaatggtcacgaataaagagggaaaagcaaattacgattggtctagatgatacatttgttccaatgggatttcgcgataaatcgggtaaattagtaggatttgatgttgatttggcaaccgctgtgttcaaaagtttgggtatcaaggtaaaatggcaacccattgattggtcaatgaaagaaacagaattaaataccagaaacattgatgctatctggaacggttatacaattacagatgaccggaaaaagaaggttgctttttcaacaccttatcacaaggcaacgcaagtgcttgttactttaaagaaaagtaacgttaataagttttctgatatgcaagataaagtattaggcgatcaaacagcttcaagtggtgatcaaacttttgcacagtatcctaaagttttgaaacaatatgttaaagatcaaaaggttattggctatgatacatttgacaaagcattcaatgatttgaatgcgagtcgcattgatgggttattgattgatgaagactatgcacgttattatgttgcgcatcagtctaacccaaatgattacacaatcacaacaggtggtttcccagtaaatgacaatgcagttggcttccgcaaagcagataaaaaattacgacaagcagtaaataaagaattaaaaacttataaaaaagacggtcgtttacaaaaatatagtacgaaatggtttggtaattgacacatactttagcagcaccgtaatggtgctgcttttatgttagaatggtattaatagtttttgttgcgctggggagggcagtatgcttaggacatctttttggattgttatattaatagcattggttatcaatacaattatttcatttattgctgtttttcggcaaaaacgtgaaattgctacaatttgggcatggatgcttgtgcttttgttgttgcctgttgtaggatttgccatcttctttttggctggtagtcgtatttctagtaaaaagatatttcgcttacggactcaagaacaacgtggtttagatcagattgctttaaatcaaaaaaaacagttacaagatattgagaacttacttcctattccatacagtgcaacagaattgttgaaattatttttatcatctgatcgcgcagttttgacacgtggtaataaaattacaatttttagtgatggacaaaaaaagtttgataaattattctcagatattagggctgcaaaggaacatattcatttagaatatttttctatttttgatgataaaataggacatcagctagttgacctattaactgaaaaagctagtgaaggtgttgaagttcgcgttatttacgatcagtttggttctcatggacaacatcctaaaatgtatagacaattacgtgcagctgggggtgttgctgtacctttcttaatgcgacgctttcagctactaactttgcgcttcaacttcagaaatcaccgtaaaattgctattattgatggtaaaattggatacatcggtggatttaatgtcggtgatcaatatattggtgaatctaaaaaatttggttattggcgtgatactcatactcgaattattggggatgcagtattatcactgcaaagtcgatttttaatggattggaacgccaccgctgaaggtagagaattattgacccagacgacaaagtactttcctgaaaacttctcgttaccagggaagtctatggttcaaattgtttccagtggtccggatgacgatatgaagcagatcaaacaaggttacatgagaatgttttcttctgcccgtgagagcataagtattcaaaccccttatttcattccggatggtcctgtgttagaaacacttgaagttgctattttatctggggttaaggtgagattaatgatacctaatcagcctgaccatcctttagtttatcgggcaacagaatattatgctcaagaattaattgatctcggcgcgacagtttaccgctatgatggtggttttttacatagcaaggttgtgatcattgataacgaggtagcaactgtcgggtcagctaatatggatatccgttcattttctcttaattttgaaggcaacgcatttatatatgatccggactttgcagctgatctagaagatttatttgagcaagatgtattaaagtccacaaaattaacaatggaatattttgagaaacagtctgcctggatgaagtttaagcaaaagtttagtagacttttctcaccaatactatgaaaaaaacaataattaatcatggcgcgaatcttgtgattctgccaactacacaatttaaaacattgcacatcgccgttgatttttcaacagcagttgagcctgagaacattagtgcacgtgcattagtgtcttatttgactgctgttagctcggcgcgttataaaacgcaacaacaagtggcgcaaaaaacaattgatttgtacggtgcccaatatcaaactgatgttttccgcattggtcaaacgcatcatgttcgctttactttgcaaataccagcacccacctacatagtgggtggaaaacagcttctgaccgaagcttttgattttttacgcgagatgatatttaatcctttgacggagaatcatgcattcaatgaacaagtatttgccaatgagcagcaaagcctaattaatgaacttgccagcgttaaagatgataaaagtcgttacgcggtggctaaacttcgtgaaataacctatgataaatctggcatgcgtgtatccgctagtggtaatgaagagactgttgctcatttaaatccatctggtgtttatcaagcttatcagaacatgatcaacgacgatgctatgaatatcgttgtgcttggtgatattaatcaacagcaaattatttcattgttagagaagtggccgattgtgccacatcaagctaaggaagaaaaagagccattttataggcaagcctctcgattacatcttagtgaattagttgagcataaaacttcgattaatcaggctatgcttaccatggcttatcaattaaatgttaaaccatttgatgatcagcgttttgctgttatggtcatgaattcgttgttgggtggtacgccactatcaaaattatttatgaatgtgcgcgagaaggagtcactagcatatagcatctattctcgttggcaacatgatactggatttttaactattgcggctggcttggatactacaaaagtgcgtcagactgacacgatgatacaagaacaaattaaagccgttcaagagggcgactttgacaatcaaacagttgatgcgattaagatgagcttaattagtgattacttaagtcaacgtgactcacctgcaagtcaaatggaagttgctttttctcgattactcacaagaagagaaacgagtgaacaggaatggattgatcgcgttaagtctgtgactgctgacgatattcaaaatgctgctcaaaagatatcgcttcaaagtcgttatatattattgcctgaggtctaatatgaaaacaaaacattatctaaagctaaaagaagatgtgattacagaaacgttagataatggtctgtcaatagtgatggttccgaagtctaattaccataaaacttttgctgtgttaacaacggcttatggtgcgttagagcaaaaatttgctatcgatgatgcacaaccaattcagattcctgctggcacagcacattttctggagcacaaactatttgaaaaagaaaatgaagatgcattcgcaagatttggtgaattgggggctgatgctaatgcatttaccaatgcttatcaaacaagttatctgttttcaactactcaaaacttaataccagccttaacacatttattagattttgttcaaacgccttatttttcaaaacaaacagtagaaaaagaacaaggaattattgggcaagaaatacaaatgtatgatgatgaccctaattgggcactctatatgggattgttaaatacattatatcccgactcgtcaattgctaaagatatcgctggaacccgtgaaacgattgcaaccatcacacctgaactactatacgctattcattctgcattttatcaacctacacagctgacactacacattgtggggcattttaatcctgaagaaatattagcagttgttaaagataatcaattcaaaaaagatttacgtcctaaaaagttaacccgtttccaggaaaaaaatttaccagcaaaagaacaacaatcagaacgctactttaatgtttcgcgtcctaaagttgcctttggtatccgacttgatcagaatcaggtcgctggtatagaagcaaccaaacgtattttaattgctgatattttggatgatttattgtttggcgagcaaacagattggtatcagaatttatatagtcatggtattattgatacagaatttgacacatcatttgatattataaaacattatcagtatgtgagtttttttgcggaaacggacgattatgacattctgacgcaagaaattcaaaatcaaattgatgattatcaaaatgttttagaaaaccaacaaaatgcttttgagtcactacgaagagctacagttggcgaggggatccagaaattgaattccttagaaaatatggctttgcaaggtgatgatgtcttgtttggaactaatctttttgataagatagagttgttacaagatttaacatttgatgacattcttgtaacagcggataaaatatatcgaaatgctacgttgcaacgatttgtgttgcataagtagtcttgtgggctattatgaatgaaactttaacaaatcaaataggcgagcaacttaaggctgctcgcttagaaaaacaattatcattggatgatatccaagaaattacaaaaatccaacgccggtatttatcagctattgaagaaaacaatcttagcgttttacctggtgatttttacgttcgtgcttttattcggcaatatgcattagctgttgggttacatcccgatgagttattaggagaaacaaaaccaatttctatgtctcgaactagcgacttgagccgggcacacagggataatgatggtattgttcgtgcggggatagataataccccaacagcaagatcacggttggcaaactctatgccaacaattggtttagggctattgattcttgtggctttaatagttatttggtttgtattgacacacataggaaccaattctcaacagacatctaacggcggtaatatctctgtttctacttctgaggtttccaaatcctctagtaaatcatcagcatcgaagtcatctgcttctagttccagtgaggaatcctcgacacttgatttaggtacaccagaaacaaatacaagtttgcagacgacaatctataatttgtctaatgaaaatactaaaaagcatacagttgttataacagcaaagaacacaggtacttcagttaaggtcaatgatgctagtagtaacattttactaaatgaaacattggctagtggcagtaaaacagtagaaattccatcgggaacaacggcatttaatctacaattttctaatgttaataatgcttcagttacagttgatggacaaaatgtcgaagtaagtggtgcaacaacatcattttggaatgtgctttttaatctcaataaataaaggatgtatcatgaatttacccaataaactaactgttttcagaattattttaattccagtatttattttattgctgacagtaccatatgcttggtctaatatcagctttttaggagcaaccatgcccgttaattggttgattgccgctgttgtctttgcaatagcctctgcaactgacttcttggacggtcagatagctcgtagccagcatttagttaccaattttggaaagtttgcggatcctttggctgacaaacttttggttatgacagcgttgattttcttaacgagcttcaatgttgttccagcttggatgactgcggttatcgttattcgagagttagccgttacaggtttacgtacactaattgttgaaaacaatggcaaggttttggcagcacagatgccaggaaagataaaaacattttcacaaatgtttgctattttcttcttatatattcacaacgcgccattttccattattaattttcctattggggatgtcttattgtgggttgctgttatctttacaatttattctggtatcgattatttttggcaaaatagaaatgtcttttctgatggtatgtaaggaactaaaagcgcttttagcgcttttttcgtataatcaagaagaaagcaaacagaaacgaacaaatgttcgaaaaacacttgcttttgactcgcgaaaaaggtacactaatcaagtaagataaaaggagttagccgcaatggtagcaaagaaaacgactaaaaaagacgatcaagcaaagaaagatggtcgtcgagccgcgctagatgaagcgctaaagaaaattgaaaagaactttgggaaaggttcagtgatgacgttaggagataacgcgctaacgcagatcgaaacgatcccttctggttctgttaaaattgatgttgctttgggtgttggtggctatcccaaggggcgtattattgaagtatacggtccagaatcatcaggtaaaacaaccatcgcacttcatgcagttgctgaagttcaaaagcaaggcggaacggctgcctatattgatgctgaaaatgctttggacgttaaatatgctgaagccctcggcgttaaaaaagacgaattacttttgtcacaaccggatacaggcgaacagggattagaaattgctgatgctttggtacaatcaggtgccgtagatatgattgttgttgactcagttgctgcattagtacctcgtgccgaaatcgaaggtgaaatgggtgatgcgcacgttggattgcaagctcgtttaatgagtcaagcactacgtaagttagcaggaaccctgaaccgaacgggaacaattgctattttcatcaatcaaattcgtgaaaaagtcggcgtaatgtttggaaacccagaaactacacccggtggtcgtgcactaaagttttattcgacagtacgtttagaagttagacgttcaacacaaattaaagacggtactgatgtcactggtaatttgacaaaagttaaaattgttaaaaacaaggtggctccaccattcaaagttgctgaagttgatattatgtatggccatggtatttcacaaactggtgaaattcttgatctcgctgttgatcaagatattatcgacaaagcaggtgcatggtatgcttacgaaggtgaacgaattggtcaagggcgtgagaaagctaaagactatttggatgatcctgagcatgccgcattgcgacaagaactatatgtcaaggtgcgtcaagcatatggtattgattctaatgcgaatggtactgccgtttcaaatacggaggctcaagcagaaaaatctgatgagcaaattaatctgccggatttggatacaacgactgatgattctttaacggacgaaccaattgtataaattacgtaaatattgagaaaaacgttaggtcgtttttcttttttttgttacaatgcaagtatagaaacgcatggagatagacatgactaagatacttgttgttgatgatgaaacggcaattgcaacgctgctgcaatacaatttgcaacagaatggttacgaagtaacagttgcatcggatggtttatccgcttatcaaaaggcaaaagagcaacaattcaatgcaatattgttggatctaatgctgccagaaatggatggcatgaccgttttaaagcagttacgtcaagataaagttagcacaccaataattttggtgactgcaaaaggggatgagtttgatcgtgtgcttggcttagaattaggtgcagatgattatatcactaagcctttcagccctcgagaagttgtagcaagactaaaagctgtattacgtcgttcacaagttagtacagataccaacaaaacgaacgaaatggttatttctatacaagatttgctcatcaatgatagcaaaaaaacagttatgaaagaaaatattgttttgtccttaacgccacgggaatatgatttattattatattttgcacagcgattgggacgtgtaattgatcgtgaaacaattttgacggctgtgtggggatatgaatatactggcgaaagccgtatggtagatatgcatatcagtaacttacgagataagattgagtcaaatccaaaggcgcctaaaatattgaaaacagttcgcggatttggatatactatgacgaattagtgttttcataagacatatgtggcgttattatagtaaatggcaaactgtagacatagcgtcgaaggtgagccatttttgttttgtaaatttttctttacacgcatttacaagaatgcgaccaaattgtggcgtgtttcataacataactcccgtaatatataagttgtaaacaaggagcggcacccaagagcctctactacaaccttgtttcactacatatttctaagggagaaatcttcatgaacaaaaagattgtaggaattattggtggtatagtggtcattgcggctggaatagccttgtatacttctgctaatgataagtccagcgataataaaacaagtacgacgtcatcttctaatgttagtggaaaagtgttatcgttaggatcaacagcattacagcctttagcagagcaagttgctaagtcattccaagagaaaaatcctaatgtaacaattacagtgcaaggtggtggatcgggtgccgggttaagtcaagtatctgatggatcagcacaaattggtaactcagatgtgtttgctgaagaaaaagatggtattgacgccactaaactagtggatcataaagtagctgtggttggtattgcgccagttgtgaatagtgatgtgcagatcacgagtttaacaaaagaacagttgcgtaatatttttactggtaaggtaacaaattggaaagaagttggtggtaacgatgaaaaaattgtcgttatcaatcgtgcaactgggtcaggaacacgggctgtttttgaaaaaagtatcttggacggtcaggatgctgtacaagcgaccgaacaagattccaatggcacggtgcaaaagattgtcaaaacaacaccaggatcgatttcgtacctggcatttgcttacctcgactctgacggtattaaggcactggacttaaataaagttcatcctaataaacaaaatgttgaagataattcatggccaatttgggcttacgaacacatgtacactaaggggaagccaactggggctactaagtcattcttagagtacttcacgaccaaagaggttcaaaaaaatattgtacctaagctaggatacattggattaacagatatgaaagtcactcgcgatgcaagtggtaaagtgacagataaataagtatatttgataaggacaagcagagtgcttgtttttttgtgcgttaccgttatgcaaattcaaaaccatgatagaataaacttatgaagaaaagaattggcaaaataaccagtatatatagtctaaatattttattattatttatagtaactcgagtgatacacgtgtctcataatcagatctacatattagttattatattttttgttgtagctaattttgaagtatggtttttaaatttttggcaaaacaaagaaacagcagaattaacaattatgaagaatagaatgattgctacttcagctggagaaacaccacggggtgttttagcagaaccaacatctccatactacgaattattagaacaattcaatgaattacaaagttatgttcgccattcgcaatatagtgccaatcgtgaaataaataattatcagacattattggccagcttaccagttggggtcattaatgttagtcgtcatcatatgatagatgttttcaatcaaaccgctgccgatatgcttggtgtagagatgccagaagtaccaattttagacagtttagtgattcgtcagtttactttgtcagaaatcattaatcatacctttaatactaatcaaaggcagcattccattttgaacttgatgattgatggcgaggcgcgacaatatgatgttagcacattatttcatcaatctggatcaaatgcagaagtgatggttatgttgtatgatttgacagaggtattgaaattagagcgcatgcaagccgattttttggcaaatgcttcgcatgagtttaaaacaccgttgactgcaataacaggatttgttgagacgttacagggtgacgcaggggcggatgaagaaacgagaacccaatttttgcaaattgtggcggatgaggcaaaacgtttgtcagcactggttaatgacatattgtctttgtcacgtatgcaacacaaagtggatgaaaaaatatctaatttgcaaatttcagccattgttgaacaacaattagaaaaaattgatactaaaacggttacggtacacaatgatattgcaccggacttcagtgtgtcaggtattgctagcgatgtgtctactatcgtccaaaatttattaactaattcggttaagtataataaaacagacggtgaagtttggatatcagcatataaagacacgcaacaatggcaaataaaagttagtgattcgggtattggtattccgttaaaccagcagtctcgtatatttgagcgcttctatcgtggtgacgaatcaagacaacgtaaaatagcaagtggtactggattggggctcgctattgtcaatgagattgtgaaccaacataatggggaaatcaatattaaatcacaggtaggtgtcggtacgacaatcagtgttattctacccttgtagaaacgcgtcaaaacattaaaattgatgtttttttgtatgaaaacatcatgctctttacacaatctttacataaaagcgttttgacatttacataagtttaagataataaatatgtagtagtaaatcttgggaggcattaacatgtcgaaatcatatcgcggttcaatcgtattcacgattgtagccgtggcagttgctgcagcgcttggaacagcgtatgcaatgcgcgataaaagtgcgtcaaatacgtcgatcactgcagttgggtcaacggctttacaaccgctggttgaagctgctggcgaggaatacgctaaagacaatcttggtaccttcatcaacgttcaaggcggtggaacaggtacagggttaagtcaggtgtcgcaaggcgctgttgacattggtaattctgatgtatttgctgaagaaaaagacggtattgatgccaaagagttagtagatcatcaagtcgcagttgtcggcattgcgccactattgaacaaacacaatggtgtcaaaaatttgacaactaaacaactcattgctgtttttactggaaaggtaacgaattggaaagaggttggtggtaatgatcaaaaaattgtcatcattaaccgtgcggccggatcagggacacgagccacttttgaacaatggggattgaatggcgcacaaagtactgaggcacaggaacaagattcttcaggaatggttcgttcaattgtcagcacgacaccaggggctatctcatatgcagcctttggttatattgatgacagtgtggtagcggctaaagttaatggtgtaaaacctactaaacagaatgtcgtttctggaaaatatgctatttggtcatatgaacatgtttacaccaaaggaaaaccatccgaacctgtagctaagtttttaaagtatttaacttccaaaaaggttcaatcaacacttgtatcgaaactaggatacatatcaattcatgacatgaagattagtcgtgacgtaaatggtcaagtgactagaaaataaacatatttcttgttcgaaaatatcatatttcgacatgcaccttggagaaaaaatggataacattacaaaaaaacttatgcagagatctgaatccacgcataaggacacgtttggacgtgctgttagtttaacggcattagccttgattggtattgtggtcgtggcaattttcgcctttgttctgagtcgcggactttcaacattctttagagatggcgttaatgttaaagactttctatttggaacaacttggaatccgtctgtaaccaacccggcaacaaagcagccttatattggtgcattaccaatgatcattggttcatttttagtaacctttttagctgcggtagttgctacgccatttgcgattggaacatctttgtttatgactgaaatagcgcaaaaacgcggggcaaaaattatgcaaccaattattgaattgctggttggtattccctcagttgtctatgggttcattggtttaactgtcgtcgttccttttatacgaaatataactggtggctctggttttggtattttatctggaacaatagttttgtttgttatgatattaccaactatcacctcgatgaccgtggacacattaaaatcagttccgcgttattaccgagaatctgctttagcaattggtgctacacgttggcaaatgatttataaagttgttttgcgttcagcaacacctggtattatgacagcgattgtgtttggcatggcacgtgcatttggtgaagccctagctgttcaaatggttattggtaatgctgcattaatgcctacaggcttaactactccagcatctaccttaacgtctgttttgaccatgggtattggaaacacggttatgggctcactacaaaatgatgttttgtggactctggcaatgattctattactgatgtcattggtatttaatttgattgttcgtgcaattggacgtagaggagcgatgaaataatgaatgcaaaaactgctgataaaattgcaacaggcgttatttacgctatttctggcattgtcgctttaattttgtttgcgatgctagcttttattcttgtacaaggcgtaccacatttatcatggcacttcttaacttctccagcacgtgcatttgaagcaggcggtggtattggaatacaactttttaattctttctacttgttaattttagccatgttgattagctttcccattgcgttgggtgcagcaatttatcttaatgaatatgcgcaaaaaaatcattttacagcaattatacgtacagctatcgaaatattaagttctttgccttctgttgttgttggtttgtttggattcttactttttgttgtacaatttaaattaggtttttctattttgtctggtgcaattgcattaacattgtttaatctacctcttttgacacgttcaatcgaaacgagtttagcacaaattcctgatttacagcgtgaagcaggtgcggcacttggcttgtcacgatgggaaacggttttgcatgttattttgcctgcagccgttccatcaattgtgacgggtgttgttctatcggctggacgagtatttggtgaagctgcagccttaatttatactgcaggacaatctgctccagctttgaattttgccgactggaatccattcaacatttcgagccctttgaatccaatgcgaccagcagagacactagctgtacatatttggaaaattaattctgaaggtattatgcctgatgttagtgccgtgtcagcaggagcttctgctgttttgattattgttgtgttgctattcaactttagcgcacgaaaattaggtatgaagctttacaagaagttaacgagtgcgtgaggccattatgataaattcaaatacagatcttaaaccagctagtgagttcattagagaaaatgcaccagagcggtttatttataaaatggataccgaaaaacatgaaattgctctgtccacacatgacttgcaagtgttttatggtgataatcttgccttgagcgaaggcgacctgcagtttgagcgttataaaattacgagcttggttggcgcttcaggatccgggaaatcaacatttttacgttcactaaaccgtatgaatgatggtgttgctaccgttaatgggaacattatgtatcgcggtttggacattaataccaagaaaattgatgtttatgaaatgcgtcgacatatcggcatggtatttcaacgtcccaatccttttgccaagtcaatttatgacaatataacttttgcactaactagccgaggtaattacactaagcagcaactagatgaagtagttgaaaccagcttgaaacaagctgctttatgggatcaagttaaggatgaactaaataaatccgcattagcattatccggtggtcaagcacagcgattggtgatcgctcgtgcgttggcattgaagcctgatattttgttgttagatgagccttcgagtgcgctagatcctatatcatccgctcaggttgaagacacgctacttaaattaaaagatcaatatacaattattattgttactcacaacatgcaacaggcagcccgaattagtgactatacagcattctttcatatgggcaaggtcattgaatacgatctaacacgaaaaatatttacgcgaccaaaagtagcacttacaaacgattacatatcaggtaactttggatgacagataataaagaaaaaacaattttatcaacccgcgatgtacatctgtggtacggtaaaaaagaggcgttgcatggtattgacttagattttccagagaagggcattactgcgttaatcggcccttcgggatcaggaaagtcaacatacttacgtgcaattaatcgtatgcatgatttagaagataatgtgacggtgacagggtctttcaaattcaaagatacggatatttatgcacccacaaccgatacggttgacctacgcaaacgtattggtatggtctttcaacagcctaatccatttccgttttcaacttatgaaaatgtggcatttggcttgcgacttgctggggtcaaagataaagctgttttagatgaagcggtagaaaaagctttgaagcaatcttctgtttgggatgaagtgaaagataatttgcacaagtcagctcttggattatccggtggtcaacagcaacgtgtctccattgcacgtgttttggctacatccccagaacttttattgttagacgaacctacatctgcgttagatccagtgtctagtcacaacattgaagaaactttgttaaaattgcgcgacgattatgcaatgattattgtgacacattcgatgtcacaagcatcacgaatttctgatcgtactgcatttttcttgagtggtgacttaattgaagttgatgagacaaagcatatcttcttggatccagcaaaaaaagaaacacaagattacgtttcaggtcgttttggctaatttacacaatttggatacagaacagttataatataataaagttaaaggaggtttcactatgcgtcgattatttgatgaagaattagcagatttagatagctcatttacagaaatgggtatgctggtttcacaaactattcaaaaagctgtgcaatcattcgtggaccacgatcgtgaaggggctcgtaagatcctagaaaatgaccaccaaattaatgagcgcgaggcagctattgaaaagaaaactttcgaaatgatagctttgtatcagccagtaaccactgatttacgtgaaattgttactatcttaaaggctgtatcagtgcttgaacgtatgggagaccaagcacgtaatattgcaaattcaacaatacgtgttaaaggcacgaagcacattgctagtgttgaacaagaactgggcgaaatgggcgagatggttgctactatggtttcagaggtcatggattactatgtgaaaaatgatgctcttggtgctgaagcgattgctgataaaaacagtgtgcttacgcaaagtgctgctaaagttcgaacagattctgttaatggtatgaaagaggacgccgaattggtagactcagcagcagattacttagtaattgcaggatacttgaagcgaattggtgattacacgacagatattgctgagtggatcgtgtacaagagaacaggaaaaattattgaattaaatcctggctataatttctttatataaaatttgtttagttaaaaggcacgacaactatgtcatgccttttaatttgctattaatttgagaaaaaaataaagttttgaatcatagttatagcaaaacgattcccaccacaatgaataggactagaaaaatcatattgactagggtaaaggttttgaagaattgaaagtttgaacgattttgcgaatagccagcgtattgccttaaggccagtaagttagctaaggaggcaataatagtgcctagaccaccaacgctgacacctaaaaataatgcatagacatggtttgtgaatttggataataatacagcagcagggacattactaatcaattgacttgtgacgatagccgatataaaagttgataaagcattatttgtatggttagtgatcagcccgctaacaaagttaatacgactaatcgcgccaacaattatgaaaaaattaatgaacgtcagtatgactgcataatcaacgcgcttaaatatttttttactaagcgtcaacccacttaggaggctaataagcagagatattattacaggaatgactgatagtatacccaataacaccactatacttgctagtagtagccacactgtttttgttcggtttatggatattatatttgaactttgtttttcaatctgtttatttttaataaacaaaacagagaaaagcaaagtgatcagtgagattaaaccaaaaggaatgctcattcctaaaaaatcaatgacacttaacttataaaaagaaacaatatatatgttttgtggattaccaaaaggtgtgaatgaactgccaaggttagcgtagatggttaacaagctaatagcgaatattttaggaaatgggatgcgtttactaatattaaagaaaatggggataagcgtcagaatagctacatcgtttgtaaataacatcgaaccaaagaacgaacagagtaaaaggactagaaaaactaagcgtgtagaatggcactttgaaacgatgtaattggcaataaattttaaaattcctaaatcttgatagatggcaataataattaacaaggatgataaggaaataatggttttaaagtcgatgtctgttgatttcacctgaccaaagcataaagataagatggacaatatgagcgttatgaaaaatgttttatcagttaaaatgcgtttcaatgtgttaatcatagattattgtgccccgatgtaacaaggaaataagttagtcgtttcataaggagttctccgtatgctttcaagtgatgtcgttatttcatgccactgctagttttacgtcatcacaatgtgatagtcaaaaagtggattgatagcacgactaattacaatagtaccaaatctgcaagagcataaacacagttaggctaaatttaattaaatactaagtatcacagatgattattagataacaaagtaagtaagtattttggatagttactttcaagtacatttgacaaactatctaggatatttgttataatggaattattgaaagcttaccatatcaatatggtaaacgttttcaaaaattataagtaatggagaatttaatgcgatttattgttcgtttagcgataaacatgctgacctttctacttttatcaatgatttttccatcaggattcagagtagatagctggggtgcagctttgttggcagcatttgtattatcgatattgaatgctatcattaaaccaattttaacaattttaacgttaccattaacaattttgacatttggcttttttgctattgttgttaatgcaatgttattggaagtgactgctgatcttgttggcggatttgaattttcaagttttggctgggcaatgattattgcacttattgtttccattattaacacgtttttgacaaaagatttgcatgtgcaagtagaaagacattaaaatggcacaaaattcagtaacagtaaaacaattagtagaaaatacccgactaaagattgttgccggtgaacagtatctagaccgagaaattactactgcagatatttctcgccctggattagaaatgacaggttatttcaattactatgcgccagaaagaattcagttgcttggtattactgaaacatcgttttctgagcgtatgagtcatgatgaattactattagtatttcgtcgcatggcggatgaaaaaacgccggcattcgttatttcaactggattaccaataagtgatgaattaaatcaagcagctgatgaagcacatattccgattttgtcatcaaccttaacatcctcacgaattttatccaacatgacatattatttgggtggtgaactcgcgccacgtaaaaatgtgcacggtgttttgattgatgttcatggattaggcgttttaattactggcgacgcgggaattggtaagacagaatcagccttggaattaattcaacaagggaaagcacgtttggtcgctgatgatcgtgtcgatatttatcaagaagatgaagagaggctgattggagagccaaacggtgtattacgtaacatgatggaagtgcgtggtgtcggaataattgatgttcagcaagtttatggtgctgtatctgttcgatcacatgctacaattgcgttaaacatccatttatctaatggtaaaattggtgaagctaattttgaccgcttaggtgacgataatgactccttagaaattttgggtgttaagattaagcgaatggttgtgccggtgacgcctggtagaaatactgcaagtgtgattgatgcagcctcggtcaagttccgtacggcgaatatgggcattgatgcgctgaaaacattggaagagcgtatgactgctgaaatggaaaagaatgaaaaaattgatgcaggggacgaaaaaaatgactaaaatagccgtattgggcggtggctcttggggcactgcgttggcaaacgttgctgcagaaaataataatgatgtgcgtctgtggacacgtactgcgacacaagcggatgaaataaacagtcaacataccaaccaaaagtatttgccagacgcaaagttatcatctgagttaatggcaaccagtaacatggccttggcagtgatggatgctgaaattgttttgacagttgttcctactaaagttgtacgagaagttgcacgtcagctagctgacgtgttaaataagcaagatcaccaggtgattttggcgcatgctactaaaggactagagcaagtaacctataagcgtgtgtcggaaatgcttgccgaagaagtacctgcaaagtaccgttccacgttggcaatgatttctggcccatcgcatgcagaagatgttatcaagcatgacttgacatctgtatcgattgcttctgaaaatgaagaggctgccaaattactacagcaggtatttgccaatagttcatttagaccttatacgaatcatgatttgttaggatcagaattggcagcggctttaaagaatattatcgccatcggatcaggtgcgttaataggattaggttatggcgctaatgcacaggctgctttgctgacacgtggtttatcggaaatgcgcgccctaggtcaagcaatgggcgcccaaccagaaacgtttttaggacttgcaggcattggtgatttgattgttactggcatgtcaccaaactccagaaattaccgtgctgggaaacagttaggtgaaggaaagagtttgcaagagattcaagatgacatgggcatggttattgagggtgttagcactacaaaagcagtatatgaattttcgcaacatcatcatgtggaaatgcctataacagccggtatttatcgcatattatatgaaaatgagccattacgcgatgtaattagcgacctaatgagtcgtccgttgcgcagtgaagattagaaaaaataaagaggaaaaaaatcatgaaaccagtacgtaaagctattattccagcagcaggattgggcacacgttttttgccagcaactaaggcattagctaaagaaatgttgccaatcgttgacacaccaacgattgaatacatcgtgcgtgaagcgattgaatctggcattgaagatatcgttattgttgatggtaaatcaaagcgttccatcgaggatcattttgattctaacccagaattagagaataatttacgtgaaaaaggaaaggatgaattattaaagcttgttgaggaaacaacagatattaatatgtatttcatccgtcaatcacatcccaagggtctcggtgatgctgtactgactgctaaagcgtttatcggtgacgaaccgtttgtggttttgctgggtgatgacttgatgcaagatgaagtaccgttgacaaaacaattgatccaacgttatgaggaaactggtgaatcaacgttagctgttatgaaagtacctcacgatcaagtatcagaatacggtgtaatagatccagccgcgcaagttgataaaggtggactatatcgtgtaaagagcttcgttgaaaagccaaagcctgaagatgcaccttcagacctagcgattattggccggtaccttttgacacctgaaattttcgaagaactagaaaatacaaaacctggtaaaggaaatgaaattcaattgactgacgctattgattcattgaacaaccgtcaacacgtatatgctcatgaatttaagggtagccgttatgatattggttcaaaaattggcttcttggaaacaaacattgaatttggtttaaagcatccgcaaacaaaagatgcattacgtgcttatattaaagaattggcatcaaagttgtaatttaaaaacaggagaaatacttcctgtttttttaaataagatggttatgctcgacaaggggtacataatcgagtacaattagtgttaacaaaaagtaagtaaaggggtaaaatatgtcagaagaactcaaggaatatgatgtggtcgttattggggctggaccagcgggaatgactgcagccacatatgcttcaagagctaatttatcagtattaatgttggatcgtggtatttatggcggccaaatgaataatacagctgaggtggaaaattaccctgggtttgattcgattttgggaccagatttagctgaaaagatgtattcttcgtcaacacaatttggtgctgaatatggttttggatcagtagaaagtattgaagttgaagattatagaaaaataattcacacagacatggggacttatgctgctaaagcaataattatcgcaactgggtcagagcatatccacttagatgtaacgggtgaagataagtatcagggtcgtggtgtaagttattgtgcggtgtgtgatggtgcatttttccgagacgaggatgttctagttattggtggtggtgattcggctatcgaagaaggtttatacctaactaatttagcaaaatcagtgacagtacttcatcgtcgtgacaaattacgcgcgcaacaaattatccaaaatcgtgcatttgataactctaaaatgaaatttgagtggcatactgaagtggtggctattactggtgacgatgacaaagttacaggcgttgacgttatcaataaccagacaaatgaaaagcgtcatattgatgcttcaggtgtgttcatttatgtaggattaaaggcaaatacgcaaggctttgaaaatctcaatattactgatccagaaggatggattgtaacagacgataagatgcaaacgagtattcccggtgtttttgctgtcggcgatgttcgtgtaaaagatttgaggcaaataactactgctgtcggcgatggtagtttggctggtcagggtgtatacgattatataagcagcttgcccgctactgaaaagattgcagaataagctaaaaaaaaaaacgatgaccaagagtcatcgtttttttttattttaattatttaacgatttcacagaattctacgataacgccatcaggtccttgaagattaaagaacttgattcctttatcccaaaatggtaaatgttgtacttctgaatcaatcagagtgaagccttcagccttagcggcatcaaaagcggcatctgcatcagtagtgtccattgaaatatggttaatagctcctggcttaccagcaacttcgtcaccgctccatgtttcgatcactagattttcacgttgcataaagatgacatttccggcaggaaaatcaccagtctttttaaaacctaatttggtccaaaatgcttcagattgttctagtgaagatgatggaataccaacgtgttgtaaacctgagtaataatcagcaaaagccataattttttcctccaaaattaatatttttcataccaaacaatgagtttatcttattcaccaacatcaacagcttggtgatctaaattacgaaatactagtttgtcagcaattccagttattccgccttggaaaagaaaggcgaagagcgttcctaagccaaaattatacagatttgggaaagtaataataaacgcaataatggcaaaaattgttggtggaatgtatgaggcccacattgctttgaaagcagagcccttaaaatacttaaaacgcaaaatttgcatcaaatcatctgctggatgcaaaaccaaattcacacgttgatatattgaaatagcagtaccaataagggcaactcctacgaagttaatcacgatgtacaaaatgaccattggcaatgactttgcatcaggcataatttgattaaaaatgtttgaaaaccattgaatgaaaattgaaaaaggtagcatgaatataaagttacctaaaattcttttccaatcaagcttcttcatcaaaaatgcatttaagaaggagattaacataccaagaactagaaaagcccagaataatgctagagaattatttcctagaatcgcgtgacctaagttagcttctgctgctgtccagtatgcagaaccaagaaaggcagggtgaatatgatcagaggtaactaatgttaagacattacccatggcattgataactagcgaaatagtaaagtaggtaatcgacaaactcattgaaatagttctagagcttttcgtctttgtctcgttttgagtcataattatgcctcttcgccgccaaccttcacaacagccttagatacgacacctaacttaccgttaacaaagtcgtcaacagtcttatagtctaattcgtgtgacatcaatgcttcaacattcaacttaccagatgatagcagagccaatgaatcttcaaatgcgttagggttgataaatgaaccttgaatagttaactgcttttggaatacttcataagtgttcatttggaacttggcgtcaggaccaccaacaccaaacatcaatacttgagcgccacgagctgatgcttcaatagcagcttcttgtgtttgtggtagaccaacggcttcaataatgacatcatattcaccttcagggatcttgtcacccttcattgtgttgtatgtgttctttacgccaaacttttccttgttcattgccaacttttcgtcaacaataccagccaagtcaacttggtgaataccatatgcttgcaagatttgaacgaataattcgcccatgaatccatccccaattaccaaagccttttggtaaggggtaaccttcaacaattgaataccgtgaacggcacatgaaattggttcaacaacagcagctgactttaatgaaacgttatcaggaattggataaacaacagatgcaggtgcagtgaagaattcttcaaagccaccatcacgtgtcacaccaacagctgacaagttttcgcataattcagggcgtgcagtacggcagtacttgcattgtccacaataaatgttagggtcaacagttacgcggtcaccaactttaacgttagtaacagcagaaccgatttctgcaacaacacctgagttctcatgaccaagaacgattggaggaacagcatcagctgaacctggcaaaccagcgtatagtgcgtgatcagttccacaaataccagcaaacgctgtgtgaatcaaaacttcatttggcaaaacctttggacggtcaatgtcctttacttctaatttcttagttccggttagaacaagtgcttccatgattaattctccttttttgtgacaaaagtaacttacggtgactatgctaaacctttggcattataaagtcaagtctcaggccaaattaattttcgattataaggctgttggtgtgataaaataatataagactatggaggtatgtaatggttgcaaaattaagtgatgtcgcagcgctagctggtgtttctgtgacaacagtatcacgtgttattaacagctatggttctttgagccaaaaaacaattgataaggtccatgctgcaatgcgtgaactacattatcaaccaaatgcaatggcacgttcattacaaggtaaatcatcacaatttataggtttgattctacctaatatggaaaacccattttttactgcactagccaatgaaatcgaacagttattgttcttaaaaggttataaagttattattgcagcatcagcaaataatgttgaaaaagagcagcaatacttgcaaatgctcgctgctaatcaagttgaaggtataataacttcttcacacaatctagatattgaagagtatcagaatacttatttaccgattgtctcttatgatcgatatctatcagatgatattcctatcgtttctgaagacaatgaggaaggaggctaccttgctggtaagtacttgctttcaacaggtgctcgacgcctattaatactgagcgatgatgatggctcgaaatcacctacacatattcgctatgatggttttttgagagcgacaaaagactcttcagccaaggtgttccaagaaaactttaacttggaagggtttgcttccaaagaagatctcgataaaatgattaactacgttataaaagacgatattgatggtgtttttgcttacaatgatgttggtgcaattcaattacaaaacgcacttagaaaaatcggcaaacgtgttccagaagatgtaaaaattataggttacgatggtacaccaatcgttcgtcagctacaccctgatttgccaacagtcgtacaaccagtgaagcaggcggcgaaagttttgattgacgtattgtttgcggtaatagaaaatcctggagaaaagccacaaaataatgaattacttggtgttgagttatttcaacccgagcaataagtgattttgttacacttttttcaaaagaatatgacattttggaggggaaatgtttataaatacattagcaacgataccggggtggattacccatctaattggtagcgacactgaattttctatatcaactttcattgtgatgtttttactaatttttgttgagacggctggtattctgacaggatttattcccggagatgctattttgattacggtcggtggcttggcagggacacatcacaatatttttgaattaggactagttattttagttttcgcctttgcatcctttttgggggatggtgttaattactggtttggcgcctatatcacaaagcaatttggtaaaattccaattattaaaaaacatgtacatggtgagttagttgaacaaatcgcaggcaattttcatccaaaacgctggttgttatttattgtcttgggacgttttttaccttttattcgtgttgcggtgccactattagctcaccgtttagggttagcatttttaaattacttaaggatgtcagcctttgctagttttctgtggtcactagtcatggtttcaataggttattttattggtcatcttgaaattccaagacgaatttcaattgccttaatcattataatggctgtagtatttatagtgattttacgcagtcctaaatgtcggcaacgcattattcaattgtttattcgaaaataaatttgttataatttaagaaattacgaaagaagaaggtaaatcatgagttataaagaagcacttacaaaatggcaagaagcgactttaccagattatttggctgctgatttagaaaaatacacaccagaccagcaggaagacgctttttatcaaaatctaagttttggtacagctggaatgcgcggtgtattgggtgcagggacaaaccgcatgaatgttttcacagttcgtcaagtaactgaagctttggcgcgttacattgatgagcaaggatcagatgcaaaaaagcgtggcgtagcaatcagttttgattcgcgtcatttttctcctgaatttgcttcaaatgcggcacaagtattgtcggcacacggaattaagagtttcctttttagttcgttgcgtccaacaccagaattgtcatttactgtacgtgaattacacgctttcgccggcattatgatcactgcatcacataatcctaaagaatataacggttacaaggtttatggagaagatggtggtcaaatggttccagaagcagttgatgctgtggttaatgaactggcgaacattactgatatttttaatattgcattagatgaagacaacaaaaatgtacaaattattgatgatgaaattgataataaatatttgaagaagatggaaacagtgacggttaacgctgaccttgttgccaaagagggtgcttcgctaaagtttgtttattcaccgctacacggaacagggcaatacattggtgaaaaagcattgcagcaggcaggtttcacaaattacacaattgtaaaagaacaagctgttattgatggtgattttccaacggttaaaaaacctaatccggaagatgctgccgcgttatcattagctattgaatatgctaagcgtgatggggcagatgctgttgtagcaacagatcctgacgctgatcgtatgggggctgctgttaaactagcggatggtacattccaaattttgacaggaaatcaaattgccgctgtgttggttaactacttattaacagctaaaaaagacacaaacactttgccaactaatgggtcgattgtgacatcaattgtatcgtcacgctttgcgtcaaaggttgctgaaagctttggtgttgaaacagctgatgtgttaactgggtttaaatatattgcagctacaattgatcaatttgaggaaacaaaatccaatacatttctgtttggttttgaagaaagttttggctacttggtcaagccattctctcatgataaagatgccattcaagcattggtattatttgcagaggtagctgcatactacaagtcacaagggaagactttcgcagatggattgtatgaattatttgagaaatttggatactttgaagagaaaacaattagcttagatttcccaggaattcatggcaatgatgaaatggcggcaattatagctggctttcgtgataaccaacccgctgaaattggcggagtaaaagttgcacgcgtgcaagacttttcaacctcagtcgaaacaaacaaagatggatcaacggctaagttatctcaaccaaaagcaaatgtgttaaagtattggttggatgatggttcttgggtggccttacgaccatcaggcacagaacctaagctaaagttctacattggggttgaatctgactcacaacaagaatcacaagctaaaattgatattatttccgccgatttaatgaagcgcgcaaaataatactagacataaaaattataatttgctataattactgttggctatcaaagcccacattaacgataatccgctgtgcgtttagcctaagggcaagtgtatgattgtcgatcaggagaatgaccaatgcgtcaaaatactattttagaaaacgttacatcagcacaattacgtactgacattcctgctttccgtgcaggagacactgttaaggtgtatgccaagatcgttgaaggttcacgtgaacgtgttcagttgtttgaaggtgttgttattaagcgcaagggcgctggcatccaagcaacttatacagttcgtaagatttcttcaggtgttggtgtggaacgtacattcccattacactcaccacgtgttgaaaagattgaagttactcgctttggtcaagtacgccgtgcaaagttgtactacttgcgtgctttgcaaggtaaggcagctcgtattaaagaacgtcgccgcgacgtttaaggtatgtaaaaggtatttcttcggagatgctttttttgttaattattccttaaaaagttatttacttcactaaatattatgtcattgtcgcgtaatacttttgtcaaaatcaagacacattattacgaatgaattagtctataatagacatatactcaaataacatttgagtttcattacttcccccagtaatgcatcaatcagctcccccaattgttgattgatacaccgataacttatgttatcaaccccctgaccaacccccctcttcggtcaggggttttttgtttgcaaaaaagtatcgaaatgtaataaaaaaccgctaacgctgtcgttaacggttttttattatttaaaaggggactgtgagttttctgtagatgttggcacattaaatggatcaatttcttcaccagataaagcacttaacccagaactttcttctgtaggcatgacggtttcatcaaacttaaaagctaacaaggagtctgtgatagactgttcacgtgaaatatcgtcgttatcgcgtacttccacaacggtagctttttctgttgtagcatgtgttcgatctaagaaagaatctcgtgcagctgcacgttgcctaagatcatcaacattaactgtttcagataggtcagtgattacttcaaaagaaacgccttcgtttttcttcaaatacttgaaattggcttctgcaatggcaccagtttgtacttcaagctgttgtgctaaaaagccggcctctaaactaaaatcagcatttttatttaacgcaagacgttgtcgcactaaatcgccagttaattcccaacgttggttcttgctattttgtgatttaatttctaaatcaccaaaggcagcgttggcaaaaaactcttttactgtcgacagtgtgtcagttggaaactgacgtgcaatttctttaccggcccagtataaaatatgcggatagtcttcttgaagtaaattctttaagagaccgtcccgtagcaaactgagtgcaaaactgtttacttgaaagtttgtttgtaaaattttatcgtaatcgttgatatccatggttgacgaaaatcctttcatttcattatacacaaaattagtgctcaaatgcttgcattttttattatcctcgtcataattaattatatgataaaaaataatcctattgggctagttgactctggtattggtggcctaactgttgtcaaagaatcccagaagcaattaccgaacgaacaattaatttatattggtgatacggcacgtatgccatatggaccgcgctccgaaaaagaagttattgactatacttttcaaatggctcattatctggtaaatgagcaaaatatcaaaatgttggtcattgcttgtaatactgccactgctagagctttatcacaattacgagaacaattatgtattccagtcattggtgtcattcaaccaggcgcagaagcggccgtttcaattagtcaaaataaaaaaattggattgattgcaactcaaggcactgtcgaatcgcaagtctacaatgaaaaaatgttagcaattgacaataatgttcagattacttcgcaagctgagcctgaatttgttactttagtggaaaataatctctatcagagtgatgaagcccgcgaggtaattgcccatcatttgagtgccttcaaagaggcaaatattgacacgctaatcttggggtgtactcattttccattactgacgccttttattcaagaagcagtcggatcggatgttacactagttgattctggcgccaagacggttgcggtgatgaaacaatatttggatgaactcgacattcattcagaagtgaaacacaatcatagcgatgatatttataacacgacaggtgataaactaaaattcaaaacgattgctagtagttggttagcacgaaatcatgagttagatgtgcgccaccttaatattgttggggaccatttggaggaagaaaagtgaagctaattatagcgagcaataatgctcataaaataactgaaattgaagccttactggcgtcaataagtattgacttacctgtcgtttcacttcaagaaataggggatgttcccgaaattgttgaagatgggacaacatttgaagaaaacgctgtgaagaaagttgaaacgattgctaaaattgcccctaatgattacattttggctgatgactctggtatgtcagtggatgctttaaatggtgaacctggagtttattcagcacgttatgctggcgatcacgatgatcaagcaaatattgataaagttttgcaaaagttagctaaggttcctaacgagcagcgaacagcacacttcaatagcgttatcgctttacatagtcctaaggggtcaaacctaatagttaacggacaagtagatggctatataacagaaagtgaacgcggacaagatggatttggatatgatccaatattttttgtacccagcatgaacaaaacctttgcagaaatgtctgcaagtgaaaaaaatacaattagtcatcgtggtttagcactgcaagaactcggtaaaaaattaccagtttggttgaaaggagaataatggttaaatttttaattgtttcagatatacacagtgatcgaaaaattttagtagatattttggctcagtggcgagataaagttgatggcattttttacaatggtgattctgaattgaacgctgatgatgacatttttgcgggtgtttctacggtaatcggtaacatggatgatgatcctgattttgctgaagcacgttcaacggttattgatggtataactttttttcaaacccacggtcacctttacaatgcgacggcaatattaaaatgggctaatttggattcgatgaacgaagctgcaaatgatgcccatgcacaagttgttttgtttggtcatacacacaaagaaggggctgtttcatatgatcataagttatttatcaatccaggttcaacaactctgccaaaggggtcacgtgcggaccttggtggaacttatgcggttctagaagtaacagatgataagtatatcgtaacgttttacacacgtcagcatcaggccgttcctgatttaactgtgacagtaaatcgataaaattttttaaaacataaaaactccttttgttataatttacttataagcttagggagtttttattacgtcatattaaacagtatgatgttcaaaaacataaccacatcatcgaacgtgtataatataggactagctatgacagaagataacccacaatttaatcaatggtatgaacaagacaccgaagtagatcatttattacgtgacgcagctgccaatgatgaagaacagcgtagtgaattatcattacgtccgcaatttttgcgtgagtatattgggcaagaggcgttaaaagaagagttaaatgtctatatttcggcagcaaagcaacgtgaagaagcattggatcatgtattgctttttggaccaccaggattaggtaaaacaacgctagcgatgattattgctaatgagatgaatgttaatattaaaacaacatcgggtcctgctattgaaaagccaggtgatttggtagcattactgaatgaactggagccgggggatatcttgtttattgatgaaatacatcgaattcctactaatattgaggaaataatgtattcagcaatggaagattattttgttgatattatggttggtcaggggccaacggcgcgtccagttcattttccgttgccgccatttactttaatcggggcaaccacgcgtcctggtatgttatccaagccacttcgtgatcgatttggcattattaactcgctacaatactatactccagaagaattacagcaaatagtcgttcgtacggcagacatctttaatgcaccaattaaatcggaaggtgcatatgaaatatcgctgcgctctcgtggcacacctcgtatcgccaatcgtttgttgaaacgcgtccgtgattttgctcaggtcgagggaaaagatgcaattgacaagaatattgtgactattggtttggataaattgcgcgttgacaatagaggtcttgacgaaaccgatcataagcttttagaaacaatgatcgaatattataaaggtgggccggttgggttaaatacaatagctgctaatattggtgaagagtcagaaacattagaggcaatggttgaaccatatttattgcagattggttttttgcagcgcacaccgcgtggacgtgttgtcactgaagcggggtacactcatttagggcacgcctatcaaaggaaattatgacaaattttattatttcagacacacatttcaatcatgaaaaaattctatattttgataaatcacgggcagtatcactgcaagcattaaatatagagccaacgattgaaaatatggatcgatatctggaggatacttggaacgaaactgtaacggatgaggacacagtttattttcttggcgatttgggcatgtttcgcaagaaacaggattttgtagcacaacttagtcgtctaaaaggtaaaaaagtgttttttaaagggaatcacgatcattcagatcaaattaaagcagcaataaagacacctgaaacaaacattattgaatatattgaaactgctaaagctataaaaatcaatggtattaatgtatggatgagccattatgcaattgatttgccataccccgttttatctgttcacggacatattcatgaagcagaatacaaacaagctagtatggtgaatttatcgcttgattcctcgtttatgcaaaaaagacgtttcggccaaccgcttacttttgatgaactaaccgaagaattgacggacagattggacaaaattcaaaatgaatatgcaattgagtccgataacaagcgttatgatcggtctgttgagcgagctttcgatgaaacgataacaattaataaaccgactgctatacagcgtcatgaattagctttattagttgatcatttgaatcaacatgatttgacatatgctgatgtcttggagcaacttgaaattccaaatgtaaataaagtgttgactgccgatgaacttgaaaaagtagcgcaaactggctttgaattcgaaaagaaaacaggtctcagtggtaacaccggcagtgtataaagtgttttctaattttttcatttgttaagccattgcaatggcttttttctttgcaaacaagtatgttacaatggaaattagattatttttaaagggattcgatatcattatggcagaagaaaaaaaatatacattatcagattttgattatgatttaccagaggcgttaattgcacaaacaccgttgaagcaacgtgatgcttcgagattattagcattgaacgctaaaactggtggctatgaggataaacatttctatgacatattagattatttgaatcctggggatgctattgtcatgaataattcacgtgttttaccagcacgtttacacggcgcacgtccggaaactggtggacatgctgaagtcttactacttcgtcaagatcatggtgatgtatgggagacgttagttaaaccagcgaaaaaatcacccgttgggtcaaccattgtttttggtgatgatattgaaaatccgattatgaccgcaacagttgttggtgaattagaacatggtggtcgatatattgaatttcattatgatggcattttcatggagctacttgatcagttgggcgaaatgccattaccaccttatattaaagaaaagcttgacgatcaagaacgttatcaaacggtctattcaaaggttgatggttcagcagcagcaccaacagcagggctacattggacacctgagttgttagatagggttcgtgccaaaggtgtcaaaacggttgaattaacgcttcatgtaggtcttggaacgttccggcctgtcgatgaagaaaatattgaagatcataaaatgcattcggaattttaccaactcagccaagaagctgcggatgaattgaattcggttagaaaacacggtgggcgtatcattgctaccggtacgacgtcaatacgtacccttgaaactattggtactaagtttaatggtgacctgaccgctgattcaggttggacggatatttttattaaaccaggatacaattggacagttgtagatgcctttataactaacttccatttgcctaaatcaacattggtcatgttagtcgctgcttttactgggcgtgataatattttgaatgcttataaacatgcggttgatgatcagtatcgtttcttcagttttggagacgcgatgtttattcataaataataaagacgaacaaaacgaaaaaaaaatacatctgactctcagacgtattttttatttgtgtatttgtttatcaaagtagaatgctataaagagtaacaacgggggtaacatgagatttattttaggtttgtgtgcattgatatcgggcatgctttttaccaaaattgtgaattcggaagcgggctctgtggagccaccttcaatgttagaaaaagtagtgctaacacaaattgaaaatggttcggtaggccaaacgccgcactctggctatgtgaatggcagttattataagacggctgaaccggctaacggttatttagatgatggaactggaaagtatttttttaaagatggcaaacgtcaaagtggtttacaaacgattggatcaaaaacttattattttgattcagtaacaaaccttgctgttaaaaatcaattgaagtccgttgataagcatacatattaccttgcttctgatgggagcgttcaataccgtgttaatggtaattttcaaacaaagctaattgctcaccgtggggcgtcaaatttagcacctgaaaattcaataccagcgtttcaattggctaaaggtagttatggtgcggagacagatatttggcttacaaaagacaagcagtgggttgtgagccatgatggtactattgatcgtatgactaacggtcatggtgctattaaagacttaaccttagctcagattaaacaatatcatattgattctggtgttaatgttggaaaataccaatcactaactttgccaaccttaaaagagtatttaactgagatgtctaataataatttacggccaattattgaaattaaacagccggctagtcaaatgagcgatggtgatgttcaaaatttaattgctgcagttaaaaatgcaggattgtataacaacagtacgataattagcctgcagtgtgaagccttaaaacacgtatatgcactagacaaaaagatttcgctcgaacttttatgggattcggctagtgatccagtgcagttgtctgaaaaattaaacgaattagggcccaaagcagggctggatattaacgggaaaaaattaacgagtcaaacaattcaagcgctcagacagcaagggcgacgactaaatgtttggacaatatcaccgtcagagttcccttattatattggactaggtgttgatgaaattacgacggatgctaacagttttagtttaaactgatttattttagggtgagtgctatgtgcgttttatgctaaactaaaagaaaccatttgaaagagagttattgcgtaaatgtatgagtatattaatgggctaatcacaaatatcacaccatcgtatattgtgattgcatcccgaagtggcgtgggatatcgcctgtacagtgctaatccttatcgttttgaggagaatgtggaatcgcatgtctatgtacagcaaattgttcgtgaaaatgacatcagcttatatggatttattgatgctgatgagaaagccttgtttaataaactattaaatgtgtcagggattgggcctaaaagtgccttagccattttggcaaacggggacgccgagggtcttattagtgcagttgaaaatgataatgtggcttatttgacacaattccctggtgtcggaaagaaaacggcgcagcaaattgttttggatttgaaagggaagttagatgagttagcatctaaaacaggtatggttgattcttcaagcaatccagaacaatcgcaagccttggatgatgcgcttgaagcactattagcacttggctacacagctaaagatgtgaaagcggtcgcccagattattggtcgtaatagcgatactacagatggatatattcgctcagctttaaagctgttggttaaataaaaacatccgcgaggatgtttttttgtagaataaattgataggcatttgaagtagtctgcatttattttgaaggatgtatttgatataataaacattgtctgaaatactgaaaatgcctctgaatattttgcgaggattaatcagatatgacaaaaatcgcgcaccagcgattacttgaaaatggctgatttaaactaattttcaagtcaaaataatgaaaacatcaggaagaaggttgtcatggtgattattactgcgggtatgatcggtgttggtaaaacaacactcacaagtttgattgcaaagcatatgaacacgaaagcattttatgaaccggtaggcgataatcccgttttaccgctttattactctgatccaaagcaatatggtttcttgttgcaaatatactttttaaatcgtcgtttcgacatgattaagcaagcgttggcggacgataataatgtgcttgatcgttcaatttatgaagatgctttgtttacagaagaaaaccacaaagatggtaatatctctgactctgagatggacgtttataccagcctattagataatatgatggttgaactacaaaaaatgcctaaaaaagctcctgatttgatggtatacgctgaaactgattttgaaaccattttataccgtattaaaaagcgtggtcgtgattatgaacaatttgataataatgaaggtttaagagcctattattataaaatgtggtcagcctatcgtgattggttcgatgcttatgatgcatctccaaaaattaaaatcgatttgcagacttatgatcttgagcaagcagataaccaaaagattattttggaacaaattgatgatgcactaaaggctattcgataaataaaaaaagaagttcaaatttgaacttctttttttattgagcctttttctcagcatctaacaagtcacggatttctgttaaaatctctaattcaggattagcttttgcttcttcttgtttgttagctttaaacaagcggttaataaacttaacaatcaggaatacaacgaaagcagtaatcaaaaaattaattacgtcatttaagaaagcaccatatttaaatgttaacgtttttgtaatgacaagctgcaactggtctaagtctgttgttccgccagttgcaaatgcaatgattggaccgattaagttagttgttaatgatttaaccaatccagtaaaggcgccaccaataatgacaccaactgccaagtcaagtacatttcctcgcataataaaagctttgaattccgataacattaagtttgctcctctattctctttaaaattattcttgattaaattatacaataaatgcagatttttgccaaaaaaaagaatactatgatactttaattttcgtttaattgatttgaatttaatttagaagtgctaaattaccaatattaagaaatgttaaggagcattattatggattttatcaaacgggctgggctctatttacggcaaaaaatagggcgtacagcgttgattacactggtaatgagtgccattatgatatttgtattggcaggtatcatcatacaaagcgctgctattcaagcaacgaatagcgctaaaaattcggcaggtacgacggttactttaagtgcagaccgtgaaaaagcttttgcctcaatgcgcaaaagtcaaagcagttcgtcttcatcaagtagctcatcgtctaatgcagcaccggctgccattacaatgccaagtgtaaaaattaaaacggctgaaaaaattgctgctttgagtaatgtggctggttatcaatatagtaatagtgcttcagtaaacgctagtggcttttcagcggttacaacatcctcatcaagtggcggcggtggtcaaggtggattcggtggttcatcaaacagcggtgatataacaattagtggtgtgtcaacaacagctgccgaaactaacttcaaatcaaaaagttataaaatcacatcaggtcgcggtattaccgccgccgataaaaatactaataatgttgtgatcgaaagtgaattggcaacaagcaacagcttaaaagttggtagcaccattaaggttaaaacaacagacgatgatgcaaaaacttatacattaaatgttgtgggtatttacaaagcaaagacatcatcatcaagtcaaggtggaccaaatatgagtgatccatcaaatacaatctatacaagttatacatttgcaggaacagttaatggtgacacaacatctgtaacaagtgttgtttacacattaacagattcatctaaagaaaaggcatttacaaagcaagctaaaaagctaatttcaagcagtttcagtttgacatctagctcggaaacttatgctttgttgatgaagcctatgaagaatgttcaaagttttgccaataagattgtttggattgttggtattgctggtacgattattttggcattaattaccgttttgatgattcgtgaacgtcgtcatgagattggtgtcttgatggcattaggagaaagtaaatttaaaattgtgcttcaacttttctcagaattatttgcggtattagtattgtctctagtgattgcaggagttgctggaaactttgtaggaagtgcggtagggaagcaacttgtttcacaacaaactactgctacgcaatcaactagcaccggcgctgggtttggtggcggtggtggacaacaatcaggtggcggcggtggatcagcaccttctggcgctggtagaagtggtcaaactagtatgacagctagtggcagtcaagtaagcaacctaaaaacaaagattagcgcaaagtcaatggctgaacttggtggcttaggtttgggaatcattgcgattgctgtcgtcgctggatcaacaccaattttccgcttaaagccaaaaaagattttgtcaaatgaataaagtaaaactattgcaaaattattcatgcgccttaatggctaatcagaaggagaattattaatgacattggcaataaaagatttaacacatcaatataatgcacaggaaaagccactatatgaacatattaatatgtcatttgaaccgaaaacattgtacagtatagtcggacaatctggttctggtaaaacaaccctgcttagttttttagcaggtttagacacaccatcagaagggacgattacgctagatggtgagaacattagtaagtatggattaaccaaataccggaatcaaaaggttgcaatcattttccaatcatataatctcttaaattatatgacggccgcacaaaatgtatcatcagcgttgtcgatgaccaaatcaaagcatactggcgacaaggattatatttatgcaaccttagagaagcttggtattaatcgtacgttggcagataaaaatgttcagcagttgtcaggtggtcagcaacaacgagttgccattgcacgagctttggctgtggatgctaaaatagttattgctgatgagccaacaggtaatctggatgaggaaaatacacaagaagttatcaaaattttccaagaactggcacatgaagttggtaaaacagttattttggttacacacgaacccaatgtggctcaagcagccgatgtgcaaattagtttaaaaaatcgtcagttcacaattgtagaataacaatcaacaaagagcgctatcatcaaaagttagtgctttttttattgacaaattaatgatgtatctatatagtttagggcatatgcaattattggggagtctataatgatcaatcaaaaaacacgttatttcgtaataacgacactttttatcgcaattgtatttttacaaatttttgttccttggcttgggttattaccccttggggcatttattgttggcgcttcagtgacgattattcaatttaccgttgccattgctagcattattttaggtccaaaatatggcgcaattgttggctgctggtggggattattatcatttgcaaatgccatcactcatccaggaacgataggttctttaatgtttcaaaatcctttgactgccattattcctcgtgttttagttggtttgattattggctatctctttaataagctactacgaaaccagtctacagcgattcggacggttgggttaggggtattaggtacaaccgcagctttaatcaacacagtaggggttgttttgctaaccacgttaggttttaccattatgcatactaacttcacgggtgtaccaacgcacaatatcttagcttggctgattagcattgtatcatttaatgccttgtttgaaatgattgtaggatttattctagtcagtataattggtagtgtattattaccaatagccgaacgagcgaatataataggatagaaaaagggtgccaaatcggcacccttttctgatgcgtccacccagactcgaactgggagctaaaacttaggaggttcttgttctatcccgttgaactatagacgcagtactcataaattataccgatatttggtgacaaaaacaaatgttaaatgaataatgttgctctatgatatgatataggcgtggaatacacataggagtaaatataatgagcaacaataagacgaaatatttggtgattacaaccttctttatggcaattatcttattacaagtactgattccttggcttggatatataccgctcggtgctgttattgtgggcgcacaaccaacaatcatacagtttaccgtagctatcgctgcaattcttctaggagcacgtcggggtgcctttattggtggcttttggggattgttaactttatggcaagcttggtcgacaccggggtctatcggttcattaatgtttcaaaatccttttacggcgtttatacctcgtattttggtaggtctaataattggtatggcgtttaataagtggttgcgcaacaaaaattttggtttccgtacgcttggattgggattcttgggcggactagccgctttgattaatacagttggagtggtcttgcttactgtcatcggttttacggtgatgcgcacgaattttaccggcatacctaatcataatttactaggctggctcataggcatcgtgtcgtttaacagcatttttgaaattattactggaatcattttagtagctgccattggtaatgttttggttcccattgctgaaagagctgggataaaagggtagcagcataataaaaaagacatcagttaagatgtcttttttattgtaaacctgattgggttttgttacttgcaatgagttgaacattattgctgtcaccgctaggtgtaaagacgatagagacttttgtaccactttggctttgccaagtagcataagcatatttttgatctgcggttaagtaagtagggttaccgtaagtagcacgaatttgatcataggtggctgaaccaagggcaacttcattataagttgctaaagaccagttcccaaatgtagttgtacttgaagaagcggcacttgatgaggaagaactatcgctaacactagatgtattgctgttatcttgtactggtgtctgcgtcgcatcttgggtagcactgcttaagacttgggaaacttcgctactagcaacagatggagctgcagccacacttgtggaagaacttataactgaagtggattcttctgctgaagtactgtttgatgtatctgaagaggtacttgctttttttgccttctttttgcttgaagatgtcgatgagctatgagaaactttgcttgaagaagttgcttttttgttgtcagattggtgaccaacaattacaaatcccatcaccactactgcaacaaaaataataattattataatggcattgcgaactttgtgtgatggtttgaatggatgacgttgcatgaggtatcttgttcctttcatctatagacatgctgtttattaatttttatctgtcatcttaacagatactattctattattaacacgctgtttcaataataccagaaaagagttgaaaagtatgctaaaatagaaacattacgtatcgagacaagcaacaaggaagacctcagtgttttagaccagcaggctcctgttattcataaatatacgaataaaaaagtgtgtagactatggtgatacctaaaacatctagttaatcgcacgtttataaaggaaagattaatgacagatttaagtattattccctttggcggagtccgcgaaaatgggaaaaacatgtatgccgtcacagttaatgacgagatttttatattggacgcaggattaaagtatccagaaacagaccagcttggtgtagatgtagtggtgccggattttgaatatttgattaagaatactgaaaaaattgctggcgttttcttgtcacacggacacgcggatgcaattggtgctttaccgtattttttgcagcaagtcaatgtaccgatttttggatccgaactaacaattgaattagctaagctagcaataaaagatcagccggcactaaaagattataatgattaccacattattaatgaaaaaagtgaaattgactttggtaatgttaaagtatccttctttaataccacacattcaattccagaatcactaggtattgtaattggtactgaatatggccaagttgtgtatactggcgattttaagtttgatcaaacagcagaaagttactatcgtactgatattcctcgtttagtagaagttggtcaggggagagtattggctttgttggctgatgctgctggtacagagggtggagctgattcagttaatgaatcaaagattggcgattatatattagaaacgttccgtgacaacaaaaaaaagcgcattattgtagcggccgttgcttcgaatattcaaagaattcagcaaattattgatgccactgctgcgacaaaacgtaagcttgtcttatcaggaaatgatatcgaaaatgttgtacggacagctatcaaattaaaaaagttgcagttacctttgccagaaagtcaactattcgtcagtttaaaaaatatgaagagtttagttgcccatgaaacggttattttagaaacaggccgcatgggggaaccaattaagcatttgaaccgcatggcaaatggtgaagacgctcacattaagattggctcagatgatcttgtgtttattaccacaacaccttctacagccatggaaagtgttgtagcaaaaacacgcgatatgattttcaagcaaggtgctgatgtgaagcagattagcactgatatgcgttcgagtggtcatgcatcacgaaatgatttacaaatgatgcttaacatcatgcaaccagcgtactttatgcctattcaaggagagtatcgtgtgatgtcagcagctaaagatgctgctgaagaggttaatttacctgaagatcatattttgatggcaatgaagggggatcaatttaagttaattgacggccaatttgagttaaaagattcgtttgctattggtgaaacgttgattgatggatccggtattggcgatattggtaacgtggtcttgcgtgatcgtcgtattttgtctgaagatggtgtttttgtttctgttgtgacaattgatcgtaaaaaacgtcaagttgtatcaaaaccaaagttaacatcacgtggatttgtttatgttaaagcaaatcgtgatttaatgaaagaagcttctgatttaaccgttaaacagattgaagattatttaactaacaataaaagttttgattggaatgagctaaaagccggtgttcgcgatgtattgtcacgtttcttatttgagcaaacaagacgccggcctatggttatgcctgtagttatggaagttaaccaaaatcgcagaccaaataaccataaaacaacggcgacacaatctggtgctcaagcaagcaaaaaaccagcacaaaagaaactggcaacacctagtagcaataaaaaaaaggttcgccgtccagcaaaaaagaacgtacaaagtaaaactactgaataataaaagtcccaactcgattgagttgggcttttgaatatttgaaaggagggcatgtgttttaatgatatactgcatgatttggatattgtttgagcacaataaattatggatgaaaatataacaccagaaaatcaagaattaattgatcgagccaatattgagacaaaacaaaaaaattggcatgatgctgctgaaacgttagccacactttacgaaaagatgcaaacattcaaagttaattatcgtctagtaacggcgttatttatggatgagcaatatcaacttgcttcatcttatgcggatgactttctattagaatatttagatgatgaatctaattttcgaatgattgtagcgcttgcagttcaaaatcaaaattttgtttatgcacaacaattggctgtactttgggatgatttagacgtcgttgatgaagttctagaggaaattagacaggctgaagaacgggcgcaagagaatatgaaagcaacacttgatactgttgcgcgtcagttttatcatatgagtgattatgatttactagcacaacgtgatcgctacgaatctgcgcgacatttaccagtagcacagtttgttgttggtgctaaatttctccttgtggatccgtacgcattacccattatccgcgcaactttattagaagatctgcaaaaactacagattgatggggtagttaagtaccgctggcttgatgatgaaatttatacgatacagctcagcgatgtaatgccattaactagttcagcagtttttgaagctgcagcagcaacacttgaaagcagattagggcaagaagaccccattgccttagaaatgttggctcatcaaatgcgcattgagctaacattgctatacccacgagttgatatcgcaataactgatattgaaaaatgggttgataacagtatcgcacattattatggtcgctctaaaccagatgagccagaaaatcaacgacaatggcatgaaaaaataaatgcgttgactgaaagcttttttgaaaattaagttcaaaacggtttacattttcttaataagtcggtataataatttctggcttcaaaagccggaaaaatgcaagttatttgttgtcttttgacggcttgcgttgtaaaatatatttataaacatttttcataatattgaaaaatgaattttggaggaaactacattggctaaggaaacttacgttcgcactaagccccacgttaacattggtactattggacacgtcgatcacggaaagacgactttgactgccgctatctcaaaggtattggctgaaaagcaaggtgttgatgctactgattttgctgaaatcgataacgcgcctgaagaaaaagaacgtggtatcacaattaacacttctcatatcgaatatgaaacagagaagcgtcactatgcccacatcgatgccccaggtcacgcggattacgttaaaaacatgatcactggtgctgcccaaatggatggtgctatcttggttgttgctgcaactgatggtcctatgccacaaacacgtgaacacatcttgttggcacgtcaagttggtgttgactacttggttgtcttcttgaacaagactgatttggttgatgatgaagaattagttgaattggttgaaatggaagttcgtgaattgttgtcagaatatgacttcccaggtgacgatattcctgtacttaagggttcagctttgaaggctttggaaggtgatcctgaacaagttaaggttatcgaagaattgatggatactgttgattcatacattccagaaccagcacgtgaaacagacaagccattcttgatgcctgtcgaagacgtcttcacaatcactggtcgtggtacagttgcttctggtcgtgttgaccgtggtgtattgactacaggaactgaagttgaaatcgttggtttgaaggacgaagttcaaaagactactgttacaggtatcgaaatgttccgtaagactttggaagaagctcaagcgggtgataacattggtgcattgttgcgtggtgttgatcgtagcaacattgaacgtggtcaagttttggcaaagccaggttcaattaagacacacaagaagttcaaggctgaagtttatgtcttgacaaaggaagaaggtggtcgtcatacaccattcttcactaactaccgtccacaattctacttccacacaactgatgttacaggtgttgttgaattgccagccggtgttgaaatggttatgcctggtgaccaagtgacattcgaaatcgaattgatctcaccagttgccatcgaacaagggttgaagtttactgttcgtgaaggtggccacactgttggtgccggaacagttactgatatcgaagactaataattttattagtattcaaaaaaacacgcgtaggcgtgtttttttttatttcttcttttcgtctttatcatgacctagtgctgcttttcgagtttcttcattactttcactagttggtaatgaaatgagatcttcgaatgaatttgatactttttcttcacgatttacaattttagccattagtagtctccatatatagtttattaaagttagttttatgcaatattatacaatgtattcagtttaatacgaataacagatgcatataaattataacactgtataatagtaattaacattagaaatggagattaataatgactgagttattgaatataaaaaacttgaaaaaacaatttggtgaaaaaataatttttgataatgtaaatgtcgctgtgcaaaaaggagaggttatctctgttattggtccttctggcgcaggtaaatctacttttttgcgcgccattaatatgttagatgcaccaactagtggtaaggtgaattttgaggatcaggatttaacaaatctgtctgaaaaagagttggatcagttacgtgaaaaaatgggtatggtgtttcaaagctttaatttgtttccaaatttgtctgtgattgagaacattaaattagcaccggtaaaagttaaaaatattagcgacaaggaagcaacagaaactgctgaaaagctacttgctcaagttggcctagccgataaaggaactgtttatccagacagtctctcaggagggcagaaacaacgtgtagcgatcgcacgtgctctggcaatgtctcctgatgtattgctctttgatgagccaacaagtgccttagatccagaaatggtaggtgaggtattaggcgtgatgaagcagttggcagaagatggaatgaccatgattgttgtaacgcatgagatggggtttgcacgtgaagtagcggatactgtatggtttatggctgacggtggtatacaagagattgctacaccacaatcattctttgataagccaaagacaaagcgggcacaagaattcttagaaaaagtgttgtaaaacaaaaagatgaacaagcaaaagaaacatgccggtgaatttgccgccacactaatagaagatggaatggttgttggtcttggaacaggttctacgatagcatactttttagatgcattagctaaacgtattcaagatgaacaaatgactattattggcgtgaccacctcaacaaagactgccagacgtgcggaagaacttggtattccgattcgtgatattgacttagtaccaatgatagatttaacaattgatggtgcggatgaggttgatcagcatttaaatggcatcaaaggtggtggagcagctttcttaatggagaaaattgtcgcgagatattctagacgtgtgatttggattattgacgaacagaagctgcatagtaaactgggacaatttcctttgccagtagaagtagtagcatttggcagtggtaaactaatagctgaactaaaaaagcgtcatttgcaccccaaattacgtctagacaaccatcagcaaccgctagtaacggacttaggacactatattgttgatctagatttagaacaaattgatcagccgtttgaactagggcgttatttagatggacagattggtatcgttgagcatgggttatttctaaatgttgcggatcaagttattattggacaggacgaaggctatcggatcatgaataacttacagaaagaaatgtaatctattaaaagcgcttacattatttttttaatagcgctataatgtagttattaagaaataagagggataggcgtatggcatataataacattttggttgcaattgatggttcagaagtttcaaacacattgataaaaaaagttgttgcgtttgctcctgattcacacattgatattttgacagtagtggataccacaggtggtggttattttggttcgatcgcaatgaatgaagacgtggtttaccaaatggaacaaactgcagaaaaggctattaatgaatcttttgattacgctaagtcattggggcataatgatgtcgatattcatgtacgttttggttcaccaaagcgcgtgattgcgcgtgatttcccgaaggaccaccataatgatttaattgtgattggtgaaaccgggctgagccgtttacaaagagcgatggcaggtacggtaccatccttcgtaacacaggtttctaaagtagatgttttgattatgcggacgtttgaaaaatgaagctcaaaaaaacaggtagcgtatgctacctgttttttattgtgcttcttttataatttcaatatttgtaatctttacgggattagctggctttgatttttcaccacttgaagttgcgctaactttagcgttggctattttatctactaccgccatgccatcaatgacttggccaaatacagtgtaattaccatccaaactaggatagccgccttttttataagcattgacaatttttgtcgggtaaatattggggttgacgccacttgaaacatcttctgggttttggacaatgaagaactgactagcattagtgtctgtacctgcatttgccattgaaacagcgccacgaatattgtatagtgaggtactaatttcatttttaaatccgttaccactatcgatattcttgtctttacctttccaaattgattgcccaccactacctgtacctgttggatcaccgccttgaatcataaaattattaataacacgatgaaatgatgtgttgttatagtaaccatctttggcgtgagtaatgaaattttcaacagctagtggtgtgtatttattgaagagttttatggtgatgtcaccataagttgtcttcatgatgagcttactctcgtttttagcaattttagttgttagttgagggagggcaactttatctagtttaggatctttttttgtactagctgttttttgctgtgtcatcagtaaaatgccaacaatgctaatgattaatatgattcccataataatatgcggcaaaaattttttcatcattaaatcctttcaataacatccgtttggacgaaccttgtaatataactgacttgtgaatagtcggcctcaagtagattatttttatattcatgccatgcttcagggacttgctcaaatttaataatgagtaaacccccgtgggttagccgcggtaagacgtatgaaatttgttgtaggtaatcggctggtcgatcgttaacatttttagcgtcatcagaataatcgaaaatggcgacactaatttggttttgtgaaccaagttcattgatgaattggtcatccaatgttttccccagcaaggttacacgatctgacaagccactcatgaaaagcgaagcagcggcagcattggcattgtccttggttgtcgcatagctaagcacttttccagcattcccaactctcgtagctaaaaatctggtattgataccatttgccgtcgtgccatcgagaactatatcgttaattttgactgtttgttcaattaattgatgtgtgaaagtattacttgtgagaatcatgaagaactcctgtagctgatttaagatcaaaaataaaatacttcgaaataaaaagtaacacgtaaccaagtgataaaccagcaagaatatcacttggataatgcacgttaacatacactctgctgattggaataatgataattaaactggttagaacaattacactggcagttttgaataaacttggctttaggtgataattgatcaaaataattaatgaaccatataataaaattgcggccatagaatgaccagagggaaagctgtagccactctcttgaataagttgtggttgtggcctgacacgagtaatcatgtgtttgagcacttgtgtaatgattccagctgagaatatgatattaacggacaaaaataaaagttcgcgataacaatgtttataggccagaaaaatactaacaattactgatactacaataattgcagtcatattgccagcctgtgtaatataagtaaaaaataaagtagtaaaggtaccacgatgttggatcaactgttggaaaaatatatcaaattggcgaaaccagttgggactcatcagaacgccaaacgtcattataccaaagagtatagtcgccaatactgtacttaatctttgtttcttttgttgaatagtcatgcattcaattatacctgattatagtaatttgtgttataataatagcattattgttcaacactattacgtatggcggggtatcagagagtaagtggcgctggaaacttaccaaacaaagttcggaactcagttgattaaattgctagtgaaactaagtagctggcaacgttttgtcgcgttaagataaatgagacgtagcaatacgtgaacatgggtggtaccgcgaaaattaagtttcgccccgtgtcatgcctttttggtgtgatatggggcttttttgtttcaacggagcgtccatgcatcactaaagagaataaataaatgataaaaggaaaaatttatggcatacgatcacaaatctattgaagccaagtggcaaaaatattgggatgaacacgagacgtttagggctcctgataaatcagaaaaagaaaagtactacgttatggatatgttcccctatccttctggacaaggattacatgttgggcatcccgaggggtatacagcgactgatattatgagtcgttataagcgtgctaaaggtttcaatgttttgcatccaatgggatgggacgcatttggattacctgcggaacaatacgcaattaaaacaggtaataatccagcaggcttcaccaacaaaaatgtccaagtgtttaaaaatcaaattaagtcacttggcttttcaattgattggtcgcgtgaaatcaatacaactgatcctgaatattataagtggtcacaatggatttttgaaaagttatacgaaaaaggcttagcctacgaagatgaaatcatggttaactgggctccagattttccaggtggtggtattgttgttgccaacgaagaagtcatcgatggtaagacagaacgtggtggttatccagtttaccgcaagccaatgaaacaatgggttttgcgcattacagcttatgccgatcgtttacttgaagatttggaagatttagattggccagaagctattaaggaacaacaacgtcactggattgggaagtcaattggtgcttctgtattcttcaatattgcagattcagacaaacaaattgaagtttataccacacgaccagatacgttgtttggtgcccagtatatggttctatcaccagaacatgaactggtagatgaaatcactacgctagagcaaaaagaagccattgccaactataaaaaagaggtagaaactaaatctgatttggaacgaacagatttgaacaaagataagaccggagcctttacaggtgcttatgctactaatccaatcaatggtgagaagttacctatttggattgctgactatgttttgtcttcttacggtactggtgctatcatggctgttccagcacatgatgatcgtgattgggaatttgctaaaaagttcaatttgccaattaaagctgttattgaaggtggcgatgttgaagaagctgcttacactgacgatggtacgcatattaattctggcttcttagatgggttaaataagcaagaagccatcgataaagctattagttggttggaagaacataatgctggtcatcaacaaattaactatcgcttgcgtgattggatcttttcacgtcaacgttattggggtgaacctattccagttattcattgggaagatggtacacaaaccctcgttcctgaatcagaattgccattgcgtctaccagaaatgacacaagaacaattaaaaccttctggaacgggagaatcaccattagctaatgctactgattggctaaatgttactcgtgaagatggtgttaaggggcgtcgtgagaccaataccatgccgcagtgggctggttcatcatggtatttcctacgttatgttgatccgcacaattcagaggcgttggctgatcctgaaaagttaaagtactggatgaatgttgatttgtacgtaggtggtgcagaacacgctgttttgcatttattgtatgcacgtttttggcacaagttcttatatgacttaggtgttgtaccaactaaagagccattccaaaaattagttaaccaaggcatgatcttaggtgaaaaccacgagaaaatgtctaaatctaaggggaatgttgttaatcctgatgaaattgttaacaattatggcgcagatacattacgtgtatatgaaatgttcatggggccattgacacaaagcaagccttggtctgaagatggcgttgccggatcgcgtcgttggttggatcgtgtatggcgtctgctagttgatgaggaagataagttacgtgaccatgtaacaacggtcaacaaaggggacttagataaaatctatcatcaaacagttaaaaaagtttcggaagatttggagaatatgcgatttaacacagctatttctcaattaatggtttttgttaatgaagcatataaatcagaagccttacctgtccagtatatggatggttttgttcaaatgttggcgccgattgcaccacacttagctgaagaactatggtcaaaacttggacatgaagaggatattagttacgtttcatggccaacttatgacgaaagtcagcttgttgaagatagtgtggaaattattttccaagtgaatggtaaagtgcgtggtaaagccactgttgctcgtaacattgataaagatgctatgctcgactatgctaaggctgatgaaaatgtccagaactttatttctggtaaggaaattcgcaaaataattgcgattcctggtaagtttgttaatattgtggtaggttaagatatcgagttaacaaatttatactttattgctagttgaagaaaagcaataatcccgtttttgcggggtacataattaaaaatgaggtctcaaacatgacgaatgatcaacgtccagaaaaattcaacggtaatagtcgcgttgataaaacagatgttgacggtaaaacgttaacggctgatgaaattctagcattggcaggacggcacttacaagaaaaacgtaatctgggaccaaaaacgacacggaagtcacgtagccatgctactatacctcagccaacagaacaagaaattttggctattaaagagaaaaatattcgtgcacggcaaaaaattataaaaaagaaacctaatttgcaggttccagaacaactatctactgctgatagctctctagagaaacaaccaacgacaaaagaaagcaatcaagcaacattaattaaaggttcagcgtggttgtccgttggaaacatggtttcacgcgtcttaggcgttgtatacttaattccgtggatggccatgcttggtagctacggtacaagagcgaacggcttatttaaccaaggatataccatctatgcaatctttttagcgatagctacatttggtattcctgcagccatttcaaaagtagtcgcggaattggcagctaaaaacgatgtctaccgatcaaggcagttaacaaggcaatctatggccttgggtattgtactaggcatagtgtttggtttgattttgtactttgctgctcccgccttatccaatgacaatgctgatgttattccagtacttcattccttagcaccggcggtagctatttttcctttaatgtcaatgatccgtggcttatttcaagggcatcaattaatgagtatatcagccatgtcacaggttgtagaacaaattgctcgggttgtttacatgctagtaatggcagttattgtgttaaaagctgacccagataattggactggtgtagttgtgcaatcaacttttgcagcatttattggtgccatttttagtatgttggtattaatgtggggatgggtgaagtatcgtcatatattgtcccgaccagtgcttcactctgtaaaacacgaaaaggctagaacactcagtttagtgctaaatattttgaaagaatcatggccatttatcattattggctctgctataacactgtttcaagctgtcgatcagtattcattctttagcataatgaatcactttttttccgtttctaaatcggatttgttggaaaaattttcactctttagtgcaaatcccaataagctcataatgattattgtgccattttcaactagtatagcggcgacagcgttaccaatgttatcaggtagtaaagctgcgttaacttatgaaacgattcaagatcaattaaagcaggtattgaagttgttctctttgattatgttgcctagtgttttgggaatgtatgcaattgcagaacctttgtataaaatgttctatccaattgaggcctcaaaccaagaaggtatttacatgctacaatactcaacaatcttggcattggtatttagtttgttcatgttgcttgcatttgtattacaagctctttcagaagttaaaattgttatgaaagcattctttgttggcattatcattaaaatcgttttgcagattccattgatacgctattttgaaggtatgggtgctttgatgacgagcgtgattggcatgttcatttcaattctctatatgttggactttttgcaaaaggtttatggtgtttcatttagtatgattggtaaagaactatggcaaatgtttatggcttcagccctaatggctattgttgcctatattatcgtctttgctatggacaactttattttcccaatggatacaaagttctcggttactgtgacaacttttagtgcggtcttgattggtggcgctttgttaatcataatgtatttgcgaatgggcttgggagatgagttattaggccgaagaatgcgttatattcctaaaatactgcaaccaaaacgatgatttttcatcgttttttttatgataaataacacctataaagacaataaaaaattcttaagatagtactttttgaggattatatagggtatgctaaaattaggttttaaattaagcttttagcggaggcaaaacaatgacagattctcaaactgtgttgcagccagaattaatcaatcggctcgatagtaaaattatgtacctcggacaattacagtctgctgtaatgaaccaacaggtgccccaagtatatgaattacttgactccaaaaaatttaacgagcaaattcgccaacgtcctcatgcagattctaatgccttactcgcccaaatggttactgacattcatgataatctggcaattttcttagcacctgaattattgaaatatttaaaacaacagtttagtttttttgattttgtggcaaccagcgatgaaccatcaatttatcaagtgtatattggcacttggtgggatcaccgccaatttgcaatcttagacgtgttgtcgctcacgttaacaattaataaaaaaatagtcagtgaatggcaagaaacaattaaattgccaactggtgcaaatatcaatgatattcaaattcgtgaaataaaacaaattacgaatggcttacaaacttttttggacgatgaaactaaacggaatttagaagtgcaagttttaaatgatcagttagctcaactaaaagaaaataaatctggactgctaggacgtactgataaaaaggctcgggaagaattagaaaataaacgtgatttgttgttggcctcgcagcaaagagttcctgaagtaaaagctaagttagctgaacacgaatccgaaatgcttcaattggaaaaagatgacgctttacgtcacctagaaatcgaagaaatattgtcacattttgatgacattgacgctttcattcaaaaagtagatcacctttatgttgactacttgaaaacactattgcagaagaaatgatatgaattttgatacttataattattcacaacaattgaagaaagacttagaagtgtttcaacggtggcaagtgttaattgaagcactttctgaagccaatcagactgctgaaatattggatattaccaaaaaaatattggcttttgacgttcataaatcagaaattatgcgtgtagcgagtgaacactggtaccccaatacacattggattgctgtggctttctcaaacttagctaaaatgacctcgctatcgcatacgcaagtcattttaccaaagatgcaaaaagtggctgaactccattttgaagaatttccaaacgcggctttccaatttaccaaggcacctttagctgcaggaggttattatttagaagaaatatctcaaaatttacgcgttgcatactgggatattgtaaataaacgtttttacttagacactgtgcatttcatgaagttagtgcaaacagaagccattcaaatcgctggtgttgaggcattaactatttttcaaaagcgcttgacagcaattagctatcttctaaaagataacgagtattctattgatattgtcggacttgatatgacagatactcaaaatttgatgatgcagcaaaaggatttgtcagctgaaatacttgatagtttgtttgttgaggcggcaaagcaaaactttgtcttaacgttattacaaaatgataaagacggagcggtattaaaaataggatctgtatcattagagattattcagcaccgtgaccaacaagagcacgcggtctggcaatatgatatcattgataataataaacgtgttacaatttatacactgtttcaacaattacctttttttgccaactggtatgaaaaatggtttaatgaagttggtctgaaggacaaacgtgcagtttttgtggattaaagccaaaactggcgtcgattagaaagaggaaacattatgacaatattgattataattgcgatcgttgtaattatcgctgttgcttgggttagcatttacaactcgcttgtaaaaacacgcatgcaaacaaaagaatcttggagccagattgacgttcaattaaagcgtcgtaatgatttgattccaaatttagtggaaactgttaaggggtacgctaagcatgaaagcggtacgttagaagaagtaacgaaacttcgtcaagaggtggaacgggccgcaacgccggctgataaaatggttgcctcaaaccaattgactggtgttttatctggattctttgcccgtgctgaagcttatcctgatttgaaagctaatacaaactttacaaagttgcaagaagaactaacaaacacggaaaacaagattgcctattcacgtcagttgtttaattcaacaacagcactttacaatacgaagttacaacaatttccaagtaatattgttgcgggaattcatcattttgaacctagtgaatttttgcaagtcccagaagctgagaaagaagtccctacggttaagttctaatgttgtaccaacaaatacaatcaaataaacggcgcaccattgtattattatttgtattttttattttggtagccttagtcggagctgcagtaggttacctattgcttaattccttagaaactggcgtagttgcggccatagttattggtgctatttacacaattattatggttagtaattcaactaatgtagtcatggcgatgaaccatggtcacgaaatcaaaaatgctgaccaagctccagaactgtggcacacagtcgaggacatggcgatggttgctcaagtaccgatgccacgggtatttattattgatgacgatagtcctaatgcttttgctaccggaaataatcctgagcattcggcagttgccgccactactgggctactgaagattatgaaccgaagcgagttagagggtgttatcgctcacgaaatgagccatgtgcgcaactacgacatacgaatttcaactattgctttagccttagccgctgctatcacactattaactaatattggtggtaattggtggttttggggcagtggtgataggcgacggaatgatgatcgtaatggtggtggtggtttacaaatactgttgttagtattttcgattttaatgatggttttagcaccgttggctgctgcagcaattcaaatggcgatttcacgtaaccgtgaatatcttgctgatgctggtagtgcggagctaacgagaaacccacaaggattgatttcagcattacgaaaattaggtaacgcacagccgatgaaggatgtggattcttcatcagctgcattgtatattagtaatcctttgaagaacaaggagcgtttgtttgatacgcatccaccaattgaagaacgtattgatcgtttagaaaaaatgtaaaatgcgtaaaggttaatataattgagcaaaacaaaaagtcacgaacatattcgtgactttttttgttatgataaagaatgatgtaatttgaattttgtggagtgttgggcgatgaaaaatattaaaattaactggcgaaaagtactacttacgatactcatcttttttgctagttcagttgtacaagtagttggattaaacgcttttttaattcctaataatgttttctcaggtggatttaacggtattgcgcagctattatctttgttctcccaaaactttttccacgttagcatgcctactggaacatttattatgatattcaacattccagttggaattgttggttggaaaatgattggtggtaaatttacaatattgagctttgctaattcactattcgtatctgctgttcaaattattgcgccaacacaagccctaaccacgaatccgctgttagcagccttatttggtggcttattaattggtgcttcgatcggattagccatgagatatggtttttcaacaggtggcatggatattgtcgcgatggttgttcaaaagcggaccggaaaatcgattggtgcgctgatgaacgtgattaatttcggcgttgttgttattgctggttcatttataggctggcaaaatgccttattcacaatcattggtatttatgcaaccggtcgtgttgttgatacgctatatactggttatcagaagttgacggcaatgattgtgacctccaaaggggatgaagtcgttgcagagttgcacaaagacctaatccgaggaattaccattttaccatcgaaaggcgcctataccaaacgtgattcgacaacattaatgatggttctttcccgttacgaattatttgaaatgcaagaggtcgtccatcgtgctgatccaaaagcgtttatcaatttaatgaacacagttagtgtttcaggggagtttcttgatgctgaccgtcagctgcagatgaagcgggcggtcgctgttccaaaagttgaaaccgtcgaggcgcagattgaagctgaacaacggctagaagagcaacttgaaaatttagacgataaaaagtaaaatataggaaatagaaggagaatacttatgccaatagtacaagtcgaattgcttgaaggtcgtactcacgaacaacttgccaaaatggtgaaagacattaccaatgttattgttgaggacgcaggcgcatcacgagaagctgttcacgttattttacgcgaaatgccaaaagaccattatgcggttggtggtgtcttaaaaagtgatcaataattttattacaaacgattaaaaacggggtattttattcaccctgtttttttgtagaaataaaatttcaagttagtaacaatagtgcattccttatgtttttttaacaatttcatgatagaattaaaatgttaagaaaaatttaaacattgagagtaaaaaataacactgattgtggtgtttagagtggaaaggtagggaaatatggaacgactggataaaaaagtagtagcttcaggactgagtttattaggtctggtaggcgttggctcgggtatcgcccatgctgatgatgttaaaagcactgtcaacaaggctgttaattctgttgccgaagctgctggactaattgataataaaacggttaatctcactcaaaagagtttaacaataccaaaagataaagtagctcatattgagacaccagctgagaaaaaagtttcccaaaaagccactactaaattaacatcatataaagtaaaggctggagattctctttggtcgattgctcataatcataatttgaatgtagatgatctcgtgagtgagaataataattctgatttgatatcagtagggcaaacattaaacttgccaactagtgttggcgccgatacacaaacaacagtggctgatcaatcaccaacagacattaataaaagtactgattcctacgctgactcgttgcaaactgccgctagcgcacctgtttcagaggtgtcagcagctggtaacgtagaatcaacggaatcttcagtcacttctagtacttccagtcaagattcgttggcctcgagctcagcagctgaaagctcagtatcttcgactccatcaagtgaagaatcaacgttggcaagcaccacagattctagtgtgtcaagtggagaatcagcgccatcaagttcagagagttcagtgacagagagttcggcagtctcgagcggatcagatgaagaaacaagttcagcgacggaggccacctcttcaacaacgtctagcacggcagatgtagcgtcagaaacgcaaaacacatcaggcaatactagtagtagtgagacaacagctgcaagtgacgctacagcttatacgagttctgcagattcaactgcaacagatgcttcagccaacatcaatagttcttacggtgcagctgctgtttcaagttccgagtcgagtgctgggcaacagtataatcagctatcttcaactacgaacagcaacggtaatttagtcaatctttctactgggtctgtcagtcaaatagtaaattctaatacaacacaatctgcgtctggaaattctgccgcaattattgcgctagcgcaacaattggtagcacaaaatattccttatgtttggggtggaggaacgccttcaactgggttggattgctctggattagtgagttatgttttcaaaaatgctgccggcatctcattaccacactcgtccgttgaacaagaaatgtacactcaaaagaagtcggtttctcaagctcagccaggtgacttactattttggggtacgccaggcgcttcataccatgtggctatttatattggcaataatcagtatattgccgcaccaaagcctggattgaatgtacgcgttgaaacgatttcaccgaactttttgccatctttcgccggttcaattaagtgatttggtgcatcaaagcaagagactaattgtagtatgagcactaatccatcaagagggataagtgctttttattttatttttaaataaatagtaaccattacttttatgtggtataattaattcatgagttactttaagtaagctcattttactattgtaattactgacagttactacacatttcttccatgattagataattgtaacttacaatttcatttatctgtttgtcagcattgcattatttaagcgccgtagcaggtgctttttcttttgaacaatccttgttttattgactatcgttttggcttgtaacctgcttttagagaacttataattaataatatagtttggttgatcttcaatgagaaaacttgaacttttgcgaaagccactcacccccgtgtggctttttgttttgcactttttgaggtaaatggacccattattagaatcaaaataatttacaaacattatgtactacgatatgattgatttgtaacattgaataaacctcaaggagaacatgtacgatgacagttgaagaaaaatttgataatgccaaggacaagattgctggaaaagcaaaggaagttgaggggaaagttactggtgacaaacaacgggaattacaaggtaaaacccaaaacattttcggtaaggcaaaagacgctgtaactgatatcaaggatgcagcagaggaagccgttaaagatacaattgatgactacaagcaagatagcaaaaaaaatattgataaataaatatatgaagaaaaaagcaactgattgtaaataaaaaaatcaggtgctttttttataagttattgagtgtttaattagttgtaaattacatatttctaggaaaattttaagtcaagtcagatggttttttcctgcctaactaacggttgctttttctcataaaagcgggtaatatgataacaacaactaaagaagttatttgcagatatatcgttggaaaacggccaacagtttctaccacgccccaaaagtcgtgactatccgcaaatgtttttgacgattcaaaagcatttgtggatctctgtgtcccagatgctttttttgtgtttaaagatgatggcggatccgttaacaattgtgttaacaaaaaggcctgattaaattatataaactaccggtgaagttcgtgttaaaaacaaattgcaatacctactggggatgggttcaattgtttatttgtttatacgacaaaggtagaatgcatgtttattttggaggatcttatgcagaagtttagttcaacaaacaagtttgtcccaatgggattaacatttgaagacgtcaagttagttgacgacttacagtcaactgtgacacctgaatctgtttcggtgaccacaagcttaacacctactttgaagcttaatattccattactatcagctgcgatggatacagtgacagaagcacgctttgccacagctttagctaagttaggtggccttggtgtcattcataaaaatatgacaattagtgcacaggctgatgaagttcgcaaggttaaaacggcaacgtttgactcagcggactttcctaatgcggctgttgatgctgaaggacatctgcttgttgctggtgccgttggtgtaacgaatgacactgtagatcgtgtgcaagctatggttgaagcaggagctgatgcaattgtactggattccgcacatggacattctgagggcgttatccgcaaggtatctgaggtgaggtcgactttccctaatttaaatattattgctggtaatattgcaactcgagaaggtgcagctgcattatacgatgcgggcgctgatgttgttaaaattggaattggccctggatcaatttgtaccacacgtgtggttgctggtattggtgtaccacaagtttctgctattcgtgatgccgcccttgaagcggctgcacgtggcaagaaaatcattgctgatggcggtgttaaaacatcattagatattgttaaagcaatatcagctggtgggaatgcggttatgcttggatcaatgttttctgggacggaagaaacacccggtgaagtgtttgaggacaatggtcaaaagtacaaaacatatcgaggtatgggttcaattgctgcgatggaaaatggatcaaaggatcgttacttccaaggtgaagtgaacgaagctaaaaagatggtaccagaaggtattgaagctcgtgttacatataaaggcgatttgacaaccattttaaatgctatgttagtagatattcataaaaaaatggcacaattaggagaaacgacgattgatgacttagttaatcatgagcatatcgcacgtgatagcgaagtatttgatttcgaagcagcaacagataagcaaaagcctgttgttgctgcccaattctaattatcattgcaaataatagttcaatcatctttggagaaaatcatgcctgaaaatacagagtttataggtcttggctacgatcaagttttgttagtaccaggagcctcaaatgttttaccatatagtgttaccttgcgtacacaattgtcagaaaattttgaattaaatattccgcttgtttcagaggcttttggtccggaaacagatacacgtgttgcgccaactgctttgaatggtgggttaggcgttgttgctgagcaagaagatttatcaaaacaagtagccagtttgcaacaagttaaggagacagtcgttgatactgaaaaatatcctaatgctttagttgattcacagaatcatttacgtgtagcagctgaagtgtggttagtggctggtgcagaaactcgtgttgctgcattggttaatgcaggagcggatgctatattcttttatttgcatggagcgttagctaagaatacgcgtgatcttattaagcaaatacgacaagcatatccagatttgttcattgctgttggtgtcgttgaagatcaaagcattgctgctgctttatatgaagcaggagcagatacaatacttgcaggacgttcagttgactcattactaccaaacgacattacatacccattcttaacagtcacaatgaatattgcagatgtggcagctgcatatgacaacaaatcagtcattgctgttggtggtattcattattcgggtgacattgttaaagcgattgcagcaggggcagatgcgacaatggtatcagatctgttaaaaggatcagtactggaatctgacggttcgtttaaagaaggagatatgtcaattgatgatgcaatcttccaaactgatggtggattacgtgccggaatgggttacacggggtcacaaacaattgaaagcctaaaattgaatgctaagattgttcaaataacagataacggtttgcgtgaatcacatccacatgatgttgaaattactaaacaagcgcctaactacgcgaaaggataagcaatggttgacaaacttgataaagtcttagttttagactatggaagccaatataatcaattaatcacacgacgtatacgtgaaatgggtgtgttttcagaacttaagtcacgtaatatgactgccgaagaaatcaagtcctataatcccaaggccatcatcttgtctggtggtcctaagtcggtttatgaggaaaatgcgtttaccattgatagcgaaatatttaatttagatattccagttttaggtgtatgctacggtatgcaactaatggcacaagaattaggcggtaaagttgaagctaatccaggcaatggcgaatttggacaaactgtcctacaacaaactgagtctgctgggcgattattagctgatacaccagtatcacaaactgttttgatgagccattcagataatgtcattgaattacctgaaggatttaaagtgattggtggctcagataaaacaccaattgctgctattgctaacgaagagcgtcgcttgtatggggttcagttccacgcagaaacgaccttgtcagaaaatggtaagcaaattttaacgaattttgttaaaaatattgctgaagcagaatctaactgggacatgagtggatttattgatgaacaaattcaaaaaattcgcgaaattgtaggcgataaaaaggtattgcttggactatcaggtggtgttgattcatccgttgttggtgttttgttgcaccgcgcgattggtgaccaattgacatctatatttgtggatcatggcttgctccgtaaaaacgaagcagatcaggtgatgacaatgttgggtggcaagtttggattaaacatcattaaagttgatgcccaagaacgttttttggataaattggccggtgtttcagatcctgaacaaaagcgaaagattattggaaatgagtttatccaagttttcaatgatgaggctaaaaagttagatggcattgaattcttagcacagggtacgctatatactgatgtgattgaatctggtaccgatacggcacaaactatcaagtcacatcataacgttggtggcttaccagaggatatgcaattccagctaattgagccacttaacacattatttaaggatgaggttcgtgaattaggtgaaaagttgaatatgccacacgaaatggtttggcgtcaaccattccctggccctggattagggattcgtattctaggagacatcactgaagacaagttagaaattgtacgtgactctgattggattttgcgtgatgaaatcgccaaagctggtctagaaggagacatatggcaatactttacggtattgactggtgtccgttcagttggtgtcatgggtgattaccgtacttacgattacacgatagcaattcgtgccattacttctgtcgatggtatgacagctgattttgcacgtatgccatgggaattattgcaaaaaatatcagctcgtattgtcaatgaagttggtcatattaaccgcgtggtgtatgatattacggctaagccacctgcaacagttgaatgggaataatctccaaaaaaataaacctcaaatgaggtttatttttttcgacaaattatctgtctttatttaattaatatgtacgtccagaaggactttttatttcaagaaattattgcggttttcccaaagatatgaaattgctaaaataagcaagcctaagttagaggcaataatagcaaaagttggttggctcataatccaactaatcaaagacgcaaacataagtatgagtgaaatcattaaaacaaaaactgacacttttttcataaaatattctccctaattttaatcgtgattgcttgaaattaaatgcaaaacataaggcacgactactaccgttcatgttatcacagcaattatctttattcaaatagaccgcttatcaaacaaagcgtaacgtttggctcaatgtgactatttttatagtgatggaataaatatgaaacacaaataaatgagcacaataatttgcactacaatccctacaacagctgtgatgatcatataacgattatgaaggattagtccagcgattaacagtgcagttaatagaagggtcagaacaaataacaatgaaaagggcactatcatattctccgatgtttttgctactgctattttatcacagatggcctgagaaaaatccaacggaatatcgacttttatacagttattgcgtctgaaatagcaaaaagactgcaataagaatattggtcaaacaaatggattatagataatttatgtgaacataaagaaacgaaaaaaacaaaacagtattgtttgaataacaataccaaaagaggtgataatgattgttccgcggctgcgaattataattccgacgaataaaaaagtaattaaacagagtgttacgaataaaataaaagtgtaaagaaaaataattgtcatgatgactccttaatgagcttagtaaaaattatatcaaattctgtaaaaggcgtacacactcgattttgagaataaatattgacatagacaaaccacccacagaaacgagtggatggcatgtgacattattatgtaatttgaatatttaacgaggattaactataaattaaatgactaattgttttctctatgatggaagatcagctgttaaatatacaatgtaactttactgtaagttgtttacaagcgcttacatttaagttatactatatatgtgacatcaaataaagttcaaggaggacattatatgtcagttgaagataagtttgataatgctcaggacaaggttgctggtaaagcaaaagaagttgagggcaaagttaccggtgacaagagtcgcgaagcacaaggtaaagcacagggactttttggtaaggcgaaagacaagttatctgatgctgccgaagccgttaaggattctgctgaagatgcagttgatgccgtcaaagatggcgtggaaaagttgaaaaaataataagtaaaaccgtccgactaactctttagttggacggtttttgaatgacttgcaacacacaagcattgacattgcttaacctaattatggttaagttcttttttatggtaaaataaaaaatatatattttacagaaaatattgagagttgcgatgacaattaattatccagtcggtactcatcacggtaagacgttaaaaaataacacattgcgtaccggtaaaacaactaaaaaggtattatttggtaagcgaggtatgggtttggaagatgaaattaatcttgcaaatgactattatcttgctaatcgtttggcagtagttcataaaaagcctacaccaataaccatagtaaaagttgactatcctgctcgctctgctgccaaaattacagaggcttattttaaacaagcctctacaactgattataatggtgtttatcaaggaaagtatattgactttgatgcaaaggaaacaaaaaataaaacgtcattccctttgaaaaatttccatgaacatcaaatttctcatttagcaagtattttgtcccaaggtggtatcgggtttgttatcatcaaatttacgagtttaaatgagaattatgtctatcctgctagcgaattaatacaacagtggcaacatttgaatggcaaacagtcgatttcttatcaagaaatagttgataagagttttgttgtgcctgaaagtttaaatccgagtttggattatctcacagctgtggataaaatgcttgaagcattacattaaattttaggagttttcaatagtatggcaaatgacaaagcgaatcaatggtcgcgtgtaaatcgtaatcataagatgtacgatcaataccctgcacaagaaccaccacgtccgccaaaaccaaatggtccaaagggtagtgggcccagaaaaccaagaaaaactaaaaagaagcgtcgttggatattagccatattcttatggttatttactcttggactgattgctgggcttgcgggaacagccttgttcttcacttatgcgaatgatgcacccaatattacagagtcggatttagcttcggaaaactctacacagctcttagattctaagggaaacgtcttttggagcatggccactcaagatcgtgattatgctaattccaatgaaatacccaaacaattaaagcaagctgttgtttctattgaagatcgacgtttttacaaacatcatggtgtagacccaatacgtattgccggagctgcaatttccaatattaagggttcttctctggggatgcagggcggatctactctgacgcaacaattagttaaattgtccgtctttagtacatcaacgtctgaccaaacatttaaacgtaaggcgcaagaagcatggttagccttacgtgtggagaagaattttactaaaaatcaaattttgacgttttatatgaacaaagtgtacatgggacacggcgtttatggaatgaaaacagcttcagaatatttttatggtaaagcgttaactgatctttctttgccacaattggctttgcttgctggtatgccacaatcaccaacttactatgatccctacttaaaggacaccacggctgcaaaagagcgtcgtgacacagttttgaaagctatggttacttatggtgcgattacgtcaaagcaagcgacagaagcaatgaaagtgcctgtcagcgatggcttacaagatttaaatgccaaaacagaggcggctaatagcactcgtcaagttgctgatgggtacgcttcatcagtgatagcggaagccaaaaagctaggttatgatacaacaaaagccggtttgaaaatctatactaatatggattctaatttacaacaatccctttatgataatgccaatgatggttctgttactttttctagtgatgacttacaaattggcgcaacaatgacagatccaaataatggtcacgttatagcccaaattggcggacgtaatgttaataccttgcaggcacttaaccgagcaaccagcaagaaccgttcatctggttcatcaattaaaccattactagattatgggccagcaattgaataccttaactggccaacttatcgaacagttgaagataaaaaatacaaatataacggtacaaacataagtgtttacaactgggataaaaaatacatgggaaacattaccatgcgtacggccttaacgcaatcgcgaaatattcctgcaatcagaaccttagaagaggttggtggttcaaatgccgagaagtttgttaatggactaggcattacgacgaactcaacaccgggtggttcaatggccattggaatcgatgtttcaaccgaacaggaggcagcagcgtttggtgctgttgctaatggtggtgtctattacaagccaacttatatttctaaaattgtcactgcagatggcacaacccatagctacacatcaagtggcacacgtgctatgaagaccagtacagccttcatgttaactgatatgatgaagggtgttatcaagcctaatgcaaccgcagcagatgccgcaatttctgggttatatcaggctggtaagtcagggctagtagcctatgatgataatgctgggatgcctgataaagcgatatcggatgcttggtttaccggctatacaaaatcgtatacgctctctgtatggactggatttgatgttcctagtaaaaattacattccttggacagagcaagatttaccggcgcagtattatgccaaagtgatggcttatgctatgcaaaataagtcaaataccgattggaccgcaccagatacagttactgctaaagtgaagggaaatatcgttgaatatgaagtcaaagatgcttcttggagtaacggtggactgccgagtgtgaattccattgcgcaatctggggaaaccccatctgaagcaggaattagtgcaaactctgcttcaactgggtctacaactggcaacaattaatttagagtttctcggtcttgctttcatagcaagaccttttcttatagaggagaatattatgcgactttgggtaacgggttaccgaagttatgaattaggaacattcggtgacaaagatcctaaaattaaagttatcaagtatgcattacatcaaacgctaaaagaacaagttgataatggattggaatgggttatcacaggtgcccagctaggcattgagcaatggacaattgaagttgttgctgatatgaagaaagactatccacaacttaaattggctgtaatgttgccttttaaacagtttggcagtcaatggagtgaggataatcaagctaaattgcagaaattgattgcacagagtgatttttctgagagcgtatcgactaaaccctttcaatcgcctattcagctgaaaaattatcagaaattcatgttagcgcacacagatggtgcattgttcttttatgatacggaatttgaagggaagacaatatttgattttcaagttgtgacaaagtatcaaacgcaaacgccgtatcctcttgtccaagtggacatgtatcagttacaagagtatgcatcggaacttgaagaaaaaatgaatgaaaatcgttacgattattagtattaaaaatgccttgtaattcattagaattattggtaacataggataagtaaaaaaataatcgaggtatagcttgtggaacaagtaaaatacacgcaaaaagacattttggaacgcgtctttaagcaaaaacgtatgggggtcggttatgatcctgctgatgttgacagctttctagatgatattattaaagactatggtgcatttggtagccgagttgaacaactaaaaagtgaagtggctcgtttacaagtcgctttgaaagatgcccaagatcaactagttgctgttaaacagcaacaaagtgttgcaccgcaacaaccagttcaaactgcttctcaacctcaaccagttgaggatcaaagacaagcagcagtcgcacagcaagcggcagtaactaacttagatttgattaagcgtgttgctaatttggagcgtgtggtgtttggtcgcgatcataatagtgctgaataaataaaaagataataatttttgcaagtatcgggtaattgcgcgttatatttctaacgtgaggaaggtccatgctcgtacactctgagatgggtgtagtgtttgtgctgggataaaaaataaacccaggaacagtgatgttacggcagtcgaaagggctaaggcttaggctatgtctgaataggctcgaaggtgccatagaaacgtatatgctagtgaaagctagtatttgagacgaggtaaaccccacaaacgggcaacccaaacttttggtaggggcggctggcctagtgaaatgaagcgatggtcggtatggttcgtttgaacgaacttagatagatgattaccgaaggtgtaatgttacctgcattacactggaacaaaacatggcctatagatacttgtaacaggtagactcgcttcggcgagtttttttgtataaaaaatttagttattcaatatattttgtatatctacgtttttttattgtataaaaattcaaatcaaggtaaaattagtaatgttgtttcacatgaggagaaattaaatgaatagtatattaaaaaaaatatcaatcgtgataatgacgattacaatgttactgccattgttagcagttttgccaactcatgctgatgctgcgactacggatccggccctaactaaaatcaagaaaaagggtacgttagtaattggtctgtcagcagattatgcaccatttgagttccatgctacggtcaacggacgtgaccaaattgttggttttgatgttgagatggctaaaaaaattgctaaggatcttggtgttaagcctgttattaaggaaatgggatttgatggtttaatcggtgccttgcaaactggtaaaattgatgtcattatttcgggtatcaatgccacaccagaacgagaaaaggtagttgatttttcaaattcatatatgaagcctttgcagactgtaatggttttgaaaaaagatgcctctaaatatagtggcaacctaaactctttttctggtaagaaaattggtgtacaaaaacaaactacccaagaaacttatgctcaagaaagtatgagtggatcaacgatagtcagtcttcaaaaagttcctgatttggttgcacaattatctactggtaaaattgctggaatcgtgcttaatgaaccaatatctaaggcttacacacaacaaaataaagcctttaaaattatttatccaaagccttcttctggagaaggggcagtttcaatcgcaatgcctaaaaattctccagtcctaaaagccaaaattaacaagtcacttggtaacatcattaagtcaggtgaattagaagcttatcaaaaaagagctaataaacttatgtttgctgatcaaagcttctgggctaagtatggtaatttgtttgtcaagggaacattgttgacgcttgccttagctgcagtggcggtagttttgggtattgtgcttggaacagtctttgccttatttaagttgtctcccaacgccattttaagaattattggtaatgtttatgttgagtatgttcgtggcacaccgttgctagtacaagcgtttatggtatttttcggtacgcaagtaattggcttgaatttatcagcttttgctgctggtgctcttgcaatgggacttaattcagctgcttatgttgctgaaatcattcgctcaggaatcaactctgttgactttggacaaacggaggcttcgcgctcacttggcttgtcaaaaggcaagacaatgcgatatgtcatattaccacaagcggtaaaaaacattttacctgctctaggtaatgaatttgtgacaattatcaaagaaggttcggttgtttctgttattggtgttggtgaattgatgttccaaactggtgtcgttcaaggagctagtttcaaaccatttttcccattagttattgcatcactgatttacttcgttttgacgtttggaattagtcgctcattgggttacgccgaaaaacgtatgaatcgtagttcacgataagttaatttaatataaataaaaaggatgcatctgtcaatgatgcatccttttttgttattcaaataatacacgaacaccttctggaactgtgaagtctttttggagtagtgataattcgccggactcttcatcacgagcgtacaatgatacattgtcggtatcttgattagcaaccaccaagaattgttcagattcatcccaattcatgtctcttgggaactcaccttcagtactgattaattgaatacgttcaatttcagatccaagattggttgttttgaagactgcgactgagttattaccacgatttgaaacatatatgaagcgaccgtctttactgatacggattgcagcagctccgttatgtgctgtccaatctgatggtatagttggtgctgtctgtacgtgttcaaaagaaccatcttcactgttgtatttcaaaacactgagtagacttgacaattcgccgaggaggtaagcatattgaccatctggcgaaaatcgaatatgacgagggccaaagccatcttctgctttgaaacgagcggcttcagctagcttgccattgtctgatacgtcaaaagtaataacttcatctgtacctagatcaactgcaactaaacggttgtcaggagttaaattgctaaagtgaatatgtgaagatccttgttcgggacgtggacctgacccttcattttgccaagtatcggttaacgtcaaattaccatcatcattaattcggtaaacttcaacagttccacggtgataataacctgcataaacaagttgacgatcttcatcaacaccaatatatgccggtgctgagccttcacttaattgtgcatcaatctcagcaaggggtcgaacggaattatcaaatgtaacaacaccaccttgaccatcacgattctcaaccgcgtagactttgttggcttttgatattgccaaataagttggatttgtcaaacccccaacgaatgtggagttttgtaataattttttctctgtatcaagctcagcttcatatataccttttgaaacgcgctttgtatacgtaccaaatagaattttatagactgccattatatagtagctcctttgaatgtctgttttaattatacttgtatgtaagcatttacacaaatataatttttagccttatttaattatcacatcatcgtaaaaatattgcaaagtaacagccattcgcaattctatggtaaaataattacaattgtatagcatgagaaggggcgtttttatgaaaaaaccagagcaacagtcatggtatagtcgttggttttctggcaatgacttgttaaatggtctgattgtaattttattagttttgctaatcatttttttggcttggcaagtacgttttttgtttgaaccaattcgtgcattatttacggctgtcggtgcacctataatgataagcggcgtgctgtattatttgctgagtccgattgtcggtcttctggaaaaatatgtgcatttaccaagaaacttatcgattggtgtggtcttgattgtcttattagctatcattggagtagccattgctgctattgtcatggtattgcgcaatcaagtcattcaatttatcgataactggccaaattactggaaaaccagcgaagcttttattaatgagacctttgccagtgaacaatttaagtttatcagagattatttgaatcatacgaattctgatcttaatcaaaatgtattagattggagcaaaaaatatttgacaagcggggttgcaggcatcagttcatttgcatcaattcttacatcaattggtgtgacaattgtttcgacgccgtttattctttattatatgctgttagatggacacaaattttcgtcatttgtttctagtaagtttccaaataactcacaactatcagtacgctacttattaacggaaattagtaagcaaatcgctcaatatattcgtggacaacttggtgttgcactcgctgtaatgattatgttttccatagggtataccattattggtttgccgtacggtattttattagcgctgatggcaggcttctttaacttaatcccgtatgttggatcaattattgcacaagtgccagttttcacagttgctttgattgctggcggcccaaaaatgctaatattagctattatcgtactagctattgaacaaccgattgaagcacatgttatttcaccaaaaattctcggggaggcgttatcaattcaccctgttactgttatcgttgtgttattgagcagtggacatatttttggtgtattaggtattgtgttagcggtgccatcatatgctgtagctaaagtgtttgttacacacatctatgattggtggcgtgcaaactcagatttatttgaagtagaggaagtagctgaaaaatgacgaatcatattgttttatttgaacctttaatgcctgctaatacgggaaatattgctcgtacgactgctggaactgatgcagtcttacatttaattgaaccgttggggtttgaacttgatgacaaacacgttaaacgtgccgggttagattattgggatcatgtaaagttggtgaaacacccaagcttgcctgattttctagacactttagcagaaacagacaacttatacttggtttctaaatttgctaaccaagactacacacagcctaattacgcacaaaatgatactgacaattacttcttatttggaaaagaaaccacagggctaccagaagtatttatgcgtcaaaatccggagaaggctattcgtatcccacaggatgattcacatgttcgttcgttgaatttatcgaatactgtcgcaattgtgctttatgaagcattgcgccagcaatctttttcaaatttagaaacaactcacacatacgagcaagacaaactgaaataaacagttgacagatataaatttccctgataaactaatatagttgtttcgttacaacgaacaactattgaccatggctcgttggtcaagtggctaagacgctgccctttcacggcggaatcgagagttcgattctctcacgagctactaaaaagcgcaactctggttgcgtttttttgtgtttaaaaattaaatttttgaaatagagttaagcaaagcttaagaatttgatgtgaacatttgttcgagtttcaaaaatgataaaataaagtgttagaatgaactgactaagaggtggaactttggcgacaagaaagactacacaaagacggcgtacaacacgtggtaaaaatagtaaaaaaaagaaccctttagttcaaaacctatgcttcttgggtggtattgtcttaggtatactaggtatatttaagcttggcatattgggggtatttattgctgacattttccgttttttctttggaaacatgtatcttgtgattttaatacctatgacattatttttagggtactattttattactcgaaaaacacccaaaatagcaactcatttttgggttggcgcttttatgatgttcattgctattgagacaatttcatcattgttattttttgaatacacactaaaaaatgcagatggatatgttggcgaagtggtgcggttaattggtcaagattttgtcaatcaatcagcaaacacaccagttggcggtggtataatcggcgcagcattatatcatctactgtttatgttaatgtctagcattggcacgtggattgtaacaataatcttattattcagtggtattgcaatctttttccgtattccagctcgtgacattgttcagcaaggcgttgaaaaagctcatgaaggggttactcatattcaggaaaaacgagctaacgaaaagccaacccgacaatcgcttttcaaacgtgatagacacaagaaagatattactgattatggagatgatccattaggtgtgagccgagatgatagcttgtcaaccgatgttgtccctaaaatagaaaaagacgtcaatgcacctagtgttcaagaaaatttcaatgagcctgaaattaaatggaatggtcctatagcgcctcaaccaacaaaaaagtcttccaaagaacaggccgaaaagacttctgttagtgatagcgaagtttctacagatatgttggaaaaagaaaacccggattaccagttaccaactgctgacctattaacgcaattagcgcctacagaccaaacaaaagagtttaaaagtttaaccgacaaatcgcgtcttgtccatgatacgctgcaaagctttggtgttgaggcggaagtaaccagtgtttcattaggacctacggtaactcaatatgagttgaaaccagggcaaggcgttaaagtaaatcgaattgctaatctatcggatgatttagcattggcattagctgcaaaatcaatacgaattgaggcgccaatccccggtaaaccctatgttggtatagaggttcctaatgatactcaggcaactgttggattccgagacatgattgagaatgcgccatttgatgataatccactcaatgtgccacttggccgagatgtaacaggaaatattatcatggcagacttatcggctatgcctcatttgcttattgctggatctactggatctggaaaatcagtagggcttaatggtattattgtatctatccttttgcgtgcaaaacctaatgaagttaaattaatgatggttgatccaaaagttgttgagttatctatttataacgggataccacacttgctgacaccagttgtttcggagccccgtaaagcagcgaagtctttgcaaaaagttgttgacgagatggaaaatcgttacaagcttttagctcaatttggaaaacgtaatattggtgaatataatgcggcggttgaaaagcagaatgctgaagctaaggaaacagatcagccaattatgcaaccaatgccatatattgttgctattgtagatgaattcgctgacctaatgagtacggtgggtaatgaaattgaagtttctatcgcgcgccttggtgctaaagctcgtgcagccggtattcacatgattttggctacacagcgacctgacgttaaagtgattaacggtaccataaaaagtaatattcctggtagaattgcttttagaacagcttctggaattgattcacgcactattctggacagtaatggtgctgagaagctgctcggaaaaggggatatgatttttgcaccgcccggtaagccgacacaacgtgttcaaggtgcatttattagtaacactgatgtgactaatattgttgaatttgttaagtcacaacaagaggttcagtattccgatgcaatgactgttacagatgaagaaattgctcaagataattcggaaaatgctgatggaaatagtgatgatgagttattccaagaagctttgcaatttgttattgaacaacaaaaagcctcaacatcactgttacaacgtcgtttcaggattggttataatcgagccgctcgattaattgatgatttggaagcaggcggttacattggaccagcagacggatcacggccaagacacgtcaatatttcagatggtagctctgggatagaaagttagcattagtttcaaactaagtagtatgattatattttttgagtagaattaaatgattaagcaaacaggagaataataaaaatggcacttacaaaaaatcaaattgctgcactacaaaatgtttttgataatggtattttagatcatgatgccgaggcattagaagcgctaaagattgtattagcagatttaaaaaaataattgcaacacagcaaaaaaaatgttatgatgtttctcagaaacattgataaggacaactcgattgtcatgcacttaaagagagttcatgtttggtgaaaatgagcagtgcatacaaaagagactacctttgagtggtgatttagtagttttaaatgaaaagttgcccgggtgataccgttatatatcatttgagagaaataggaatttttcctgttttaaacttgggtggtaccgcggtaaaacgtccctttagatctaataaggatctaaagggacgtttttgttttattaatgtaaaatactagaatggaatttgaaaggaaaatagcatggcagaaatcagtcttacattcccagatggcgctattaaaaagtttgatgaagggattaagccaattggggttgccgaaagtatttcaaagtcattggcaaagaagtcagtgtcaggaaaaataaatggttcatacattggcatgaacgatgttattattgaaagtggcgattttcaactaatcactacatcagatagcgaagcattagatctacttcgtcactcagcatctcatttattagcacaagcattaaagcgaattccaaaatttgctaacattcattttggagttggtccttttattgaaaatggcttctattacgacacagataatggggctggcaatcaagtgtcaatcgaagatttccctgaaatcgaggcgatgatgcacaaaattgtgaaagaggatctaccaattctttctcgcgaaatcacacgtgatgaagcattagaaatatttgctgatgatccatataaagttgagttagtaaatgatctaccagtcgatgaaaagatcacaattgctgttcaaggagatcatattgagcttgataagggtggtctggtaccatcaacgggttggattaagcattttaagcttacttcagtggctggcgcttactggcgtggagattcaagcaacccaatgatgcaacgagtatatggaacggccttttggaaagcagctgacgttgaagcagaaattgctcgtcgtgaagaagctaaggaacgtgatcatcgtgtcattggacgtgatcttgatctattctttactagccaggaggttggttcaggattaccagtttggctgccaaatggtgcaacaattcgtcgccaagttgaaagatatattacagataaagagctgtcaaatggctaccagcacgtttacacaccagtattgtctaatttgaacttatataagacatctggtcactgggaccattatcgtgaagatatgttcccaccaatggatatgggggatggcgaatttttggaattacgtccaatgaattgtccatcacatatcatggtatttaatcataagccacgttcataccgtgaattaccaatgcgtattgctgaattaggaatgatgcatcgttatgaaaaatctggtgctttgacagggttatctcgtgttcgtgagatgacattgaacgatggtcatacattcgttgaaccagaaaagttagaagaagagtttaagtctattctaacaatgatgatgggtgtctatcgtgacttcaacattaaagattatcgtttccgtttgtcttatcgtgatcctaaaaatacagaaaagtattttgatgatgatgaaatgtgggaaaagtcacaaaagcaattgaaaacagcaatggatgatctcggtcttgattatttcgaggctgaaggtgaagctgctttctatggtccaaagttagacgttcaaacaaagactgccttaggtaatgaagaaacattgtcaactatccaattagacttcttgttgccagaacgatttgacttgaaatatattggtcgtgatggtctggataatcatcgtccagtgatgttacatcgtggtattgttgggacgatggaacgtttcacagcctacttgattgaaatgtacaagggtgctttcccaacctggttgtcacctttacaagtacaaatcatccctgttaatttaggtgctcatggtaattatgcgaacgctgtacagcagaagttacaggatgctggattgcgcgctaatgttgaaacaaaagacgctaagatgggctacctcattcgtgaagcgcaaacgaacaaaattccatatactttggtactaggcgattcagaggtagatagtaacacggttactgttcgtaagtatggtgatacaaaaacagttacaatgtcatacgacgaattacaatatttaattttgtctgatgtttctaattactcacgtgaaaccgaatgaacaaaatagcgttgtttatttttagaaaaaaatcagcatactagatcatgtatgtatgaaaagtcaaagcaccctgagatcatcgaggggtgctttgcaataggaaagggaaatttatattattatgtccgattcaaaaggcgacagtaatcttccgaaacgaggtttacaaaaccgacacgttcagttaatagctattggtggaacaattggtactggtctattcatgggggcaggaaattcaatccattttgctggaccgtccattttattggtttacttagttattgggatgtttatgtttgttgtgatgcgtgccattggtgaactgctgtatgctgatcccagtcaacatacctttatttctttcatcactaaatttttaggtaaccgtgccggattctttgcacgttggtcatattggttaactgttgtatttatggggatggcagagctgactgcagtggcaaaatatattcagttttggctgccggatttaccaagttggttgattcaaatcgtcatgcttattttgctaacgtcgatcaacttaattgccgtagcactttatggtgaaactgaattctggtttgccatgataaagattgtagccatcctatcattgattgtgacaggtattatcatggctttgacaggattcgaaacaccagttggaaaagttgcttttagtaatgtttggcatcactttgagttatttcctaacggggttggtaattttattaatgcctttcaaatggtcatgtttgcatttgtcggcatggaatttattggcatgacaacggctgaaacggaaaatccccgttcggttttgcccaaagcgattaaccaaattccttggcgcatattgtttttctatctgggtgcattgttcattattatgacgatttatccatggcagaaaattccagaggatcaaagtcctttcgtgatggttttccagttggcaggtgtgaaatgggctgccgctttaattaatttcgtagtattaacgagtgctgcttcagcattaaattcagttttgtttagtgctagccgtaatttctttgctttatcattccaatctaaggccaagtttttacaaccatttagaaaaacatcaaaaacacaattaccagtgaatgctgtactggttacatcattaatggttgctttttcggccttaatctcggttattccatcaatcacaaatgcatttagttttgtgacaagcgcatcgacggacttgtttttgatgatttatgtactcatattattcgcttacatgaagtatcgcaagtcagatagttacatgcctgatggctttcttgtcatagcacccaagacgttagtgccattggcaattctgtttttcagttttgtatttattacgcttttctttaatccagaatctcgtctaccagcaattggtgctaccatttggatggtcgtgtttggctgtatttcaatgagacaaccaaaacaggcattaaataagtaagttaccgtaatttttctggttagaaggcaattaaaatcgcaatagggatgaaaaggtatattttaatatgacatgctcacatgtgtggtaaaatattactattcgtactttaggggaactttatgtcatttctaattgattttattttgcacattgatgtccatattggtaatcttgtgcaagcgttcggtttatggacgtatttgattttatttgcagtgattttcattgaaactggtagtgtgattatgccgtttctacctggagattcactgttgtttgctgcaggagctattgctgctacgcctgctgggctaaatgccggacttaatcattgggtatttatgattgtattcttcttagcagctgttattggtgactcagtcaatttttggattggtcgtacaggtggttataaaattttacatcatcgtttctttggtcgtttcattaaagaacaacatatcaaagaagctgaagctttctttgaaaagcgtggtgctgcggcaataatcattgggcgatacatgccgattgtccgcacatttgtaccgtttgtggctggtatcagccaattttcatacaaacatttcctacgtaatagtttgattgctgcgttctcttggagtttaattgcaaccggtgctggttatatgttcggaaatattccatttgttaaagcacacttttctgtaattattttgggtattgcgttggtcacattaatgccaacaatcattggtgtcgttcgttcagcaatggttgcaaagaaacagaaaaaaataatgtcgaaataaccgccattcatggcggtttttctgtataattataactatgaataacttaaaaaaactacaagaattaactaaaatttcaacaatagagattgctgatgcactagatgttgaagttgaaactgttgaagcatggcaaaatgaagaaaaagtacccagtgtgagtgattttgaggcattaagtggcatcttctcttctcaattggatgctcaaggaagcgactctcaatccagcaagcatccaatccacattcgtttatctgtggattatctattgaacctaggaataacactttcagattggattactttaaagtgggcctttgaaggtcagtggaataatgatcagttagccatcggatttttttctaataatcaattagtacgtgttattagcactgaaagtgaattttcggatgcttttgcaggctatctgattttacaaactgaaggtgagtttgaaccatatattgatgaatttgataatgatagggaatacgattggcgtttgttgcgtttgaacgatgaaaaatttgtggatgtaactaacgatttaattgcagccaatttaccagtcatcagctaacagtagagaagtacacaaagtagtgacgtctgtataatattatgatacactacaatcagatgataatacctgtgagacaattgaataaatttgtcgataataagggtattattttgccaaaaacacagttttcgtaatgaaaattgtgtttttttgttccgataataaattttggaggataatatggacttaggcaacgattttgttactcgtttgggacttgaaaaaccacacgacttagaaaaggtacgtggtggcgacattaacgaggcgttttcaatctattcgaataaccagcgctattttttaaagattcaacaaaatgctcaagcaagtttttttgatcatgaagttgctggcttgaaggctttgggggaagtggtgactgtgccagccgttttagcacagggacagttacaagggcacgcctacttagtcttgacgtggattaatcaaggaaatgggtcacaacaagaattagcaaagtcgctggttaaaatgcaccaagctacagcgccaaagtttggatttgatagtgataacttagtagattttgtgcctaaaaataatacttggcaatcttcttgggctgaattctttgtgaaacaacgcttggatccgctaatggcacaagcgcaaaaaaataatttttggcttacccaacgtggtgatcactatagtaaattacgtgaaacaatattaaatgataatcacgcgcaaacagttcaaccatcactactgcatggtgatttctgggcaggaaactttatgtttaacgatcaaggtaagcctgtatttattgatcctaacgtgttctacggtgatcgggaatatgatttggcgatttcaagagtgtttgccggctttagtccgtcattttataatcaatatatgcaagaatggccattggatgatggctggcaaaaacgtgaaaaatggtatgagttttattatatactaattcactttacacgctttggtgatatttatgcaccgcggatgaacaaattattaacgtctttttaaaatcacatgattgctagcaaagaattagacgaaaaaaccttgacattcaataatgattcagtcataataatgacagaataaaaattatttcacatagaggtcgcgattgacaatacacttaccggagttgctgtagcaattgatagtaagcttaggggatatcgccgaaatcaagggtgtctacaaatgaccttgattgggctaatagttaagagctattagactgtcgcagagatgcggtgagctatggaaactgtcaaaaatgctaacaatgccctttgataagtccgttttgcgaacctatcaaagggtttttttgtgtaattcaaggggaaatgatgacgtatccaataaatgaaaagcaacatctgacagttgatggtgttgatacaatcgaactggcaaagacatatggcacgccgttagcagtttacgatgtaacacttattcgtaagacaatgagagcgtttaagcgtatctttgaacaagaaaatgtcccatatgtagtgagttatgctggtaaagcttttgctactaaagcaatttatcaggtggcagctcaagaaaatattcacgctgatgtcgtgtctggtggggaattatacacagcaattaaagctgattttccaactcagcatcttagttttaatggtaataataagagttatgatgaacttgtgatggccgttgaaaatggtgtgggaacaattattgttgataattttcttgagttacagatactgtcagaaattacggcggaaaaaaatgttattcaagatattttactacgtatttcaccaggaatttcagctcatactcatgaatttattagtactggtcaacaagatagtaaatttggctttgatttacaaacaggtcaagcgaagcaggcctatgatattgcaataaaagataaccatcttcatttgcgtggcttacatgcgcatattggatctcaaatatttgatgtgactggatttgagaaaaatgcagcactattagcagatactgcttactcatggggatggcaaccagaagtcattaatactggcggtggatttggtattcgttatactgatgaggatcaacctttgccagaaagcgagtttgcggatgctattatccgtgttttgaaagaaaaggctacacagtacgattgggcaatgccagaaatatggattgaacctggtcgttcgattgtcggaccagccggacaaaccctatatacagttgggtcgcgtaaggatattccgggaattagaaattacttggctgtagatggtggtatgggagataatattcgtccagcactttatcaagcaaattacgaagcggttttagccaatcaaccaaatgctaaaagtgaagaaattgtgcggattgctggtaaatattgtgagtcaggtgacgtattggtttggcaggaagaattaccggcgacaaaacctggtgacattttatctgtgcttgcaacaggtgcgtacgggtatgcaatggcttcaaattataaccgaaatccacgaccggccgttgtcttcgtggaaaatggtcaacatcaagtcgttgttgaacgtgaaacttttgaacacatgatcagtttagatcaggattatactctaggagataaataacatggctgaaaacgaagcacaaaaactaattaatttcattgcaaatgcaaaaaaaattaccccagtaaaagttacatataaaggcacattggcaactgaagtaccagatactgtgcaacaatttggaaatgagtcatttggacaattaattggcgactggtctgaaattgaattgttaattaagaatctaccatcagaagatgtatttattgaaaatgattcacgtaactctgccgttcctttgcttgataaaaaagaaattaatgctcgcattgaaccaggtgccattattcgcgatcaagttgaaattggtgacaatgcggtgattatgttgggcgcagtgattaatattggtgcagagattggtgctaacacaatgattgatatgggtgctgtacttggcggccgtgccattgttggtgaaaattctcatattggtgctggcgcggtattagctggtgtgattgagccagcatctgcccaacctgttcgtatcggaaataacgttctagttggcgctaatgccgtcgttattgaaggcgtacaggtcggtgacggcgcagtagttgcggctggagcgattgtcacaaaggatgtaccagccaatacagtagttgcgggtgttcctgcaaaagtcattaaggagattgattcgaagacgcaacaaaagactgcgttaattgacgcattgcgaggcttataatgccagttagtgaagaagatttgaaaacctatcggcgtgacttacataaaattccagaacttgctttagcggaatttaaaacgcatcgttatttgttagaaaagattcaatcttggcaaactaattttatgacaatacgtcaagtagaagaattacctacggcattgcttgtgaaattttctgggactgacccaagccggacggtaggatatcgtgctgatattgacgcgctaccagttacagaagatactggattgccatttgaatcaacacataaaggtgttatgcatgcatgtggtcatgatgttcacatgtctttagctttgggattagttcagtattttagtgagcatcaacctaaagacaatttaattgtctttttccaaccggctgaagagtcaaaaagtggtggcaaattagcggttgatttaggaatctttgaaggtgagtggcatcctgatgaattttacggcattcatgatcagcctaatttacctgctggaactttgagtaccttagcgggcactttatttgctggaacggccgagctcgaaattgacatccatgggcaaggtggtcatgcggcctatccccacttaggtaaggatccaattgtcatttcggctgaattaattatgttgttacaaactgttgtatcgcgtgacgttgatccgatagaaggtggtgtagtgagtcttggaatgattagcggcggctttacaaataatgttattccagacacggtgcatcttgccggaacagttcgtagtatgaccaaagatggcttggataaaatgacaacacgaattcgccaaatcgttgaaggtgtggcgttggcaaatgaggtcaagattaatgttcgccttgaaacaggaagttatttgcctgttgaaaacaatcctgacttagctaacaatttgctgagtttcatggaacagcgtcaagacattgcttttgaagaagcaaaacctgcgatgacaggtgaggattttggttacatattgcaacatattcctggtgtcatgctttggctgggtgttaatgacaatcattcactgcacagtgccaagttaaacatcgatgaagcagctttgttgccaggatttaatgctttgaaagattttattgagtggcgaatgtcacaaggagaataagcatgtacgaaggaattaatttaattacggcaattattacgccttttacagtaaacgatgagattgattatgagtcattagagaaattaattgaacacctgttaaatcatggttcgcaaggatttgtgattgcaggaacaacaggtgaatctccaacactgtcttttgaagagaaagtagagttgacacggtttattgcaaaacaggttggtaatcgtgcacttttaattgctaatgcaggttccaataatacaaaggaatccgtagaagcagccaaagctttaagcaaaatcgagcatattgacggcatcttggcagtaacaccgtattataataagccaagtcaatctggtatgattgcacattttaaagctatcgctgatgcatccgaaaagcctgttatgttatataacattcctggacgtacggtggtcggtctcacggttgatagtgtgattgaattagctcaacatcctaatattaatgcaattaaggaaacaacatcaactgaatttgttgaagcagaggtagaagggaccactggatttgcagtctatactggtgaagatgcaatgactctttcggcttacactgtcggcggtgctggaacaatttcggtagcttcacatctttatggtgacgaaatgtctgaattgttttctgctatgaatgcaggtaattggcgcgaagctgggcgtttgcaacgttacctaaccccacgaatgaatgccctatttgcttacccttccccaactccagttaagacgaaattagccgaaaaaggattcgtacgtgaagctgtacgtctgcctcttattcctttaagtgacgcagaaaaattacatttgaatgaattattggagaaataatgacaaaaataattttagctggtggttttggtaaattaggccaagctattcaagataacttgaatgaagaatatgaaattgttggtattgtgagtggtcatcaacatgagagtaaggtacctgtatggacctccttatcagatattaatgtggcagcagatatttggctggatgtcagtaccccagcaactgtatttgacaatgcaatgtacgcaatcgagcacaacatgccgctagtgattggtgccactggtttgtctgatgaacaagtagcaatactgcgtgaacagtcatcaaaaggcgttttaattgtaccaaactttagtttatcagcggttttgttaatgcaattctcacagttagcggccaaatattttcctgatgcagaaattattgaagcgcacaaccctaaaaaggtggatgcaccatctggaacggctaagcaaacagcaagattgattgcaaaagcccgcattgcggaacctacatcaacaaaattagcgccagctcgcggcgaacagattgatcgtgtgccagttcatgctgtacggttacctggctatatcgcacagcaaagcgtttattttggtggtgtggatgagcaattaacgctgacccaaagtacaacaagtcgatcagcctttgtaccaggtgtaattcgcgctatagaagctgtgaaaaatatagacggtgttgtcatcggattagaccaaattatttaatttaaaaattgtgatgttaatgtcagtattagcatcattttttattttaaaatacatgtgaatagcaatatttgtcgtacaatagagttatgaaaaagataactaaaatttcaattcaaaaaaaagcgggtcgctataatattgatctagataatcaattcgcttttggtgtggcggaaagtgttctcattaaatttggtttggcgaaagggcgagaattagatgccgaattaattgcagaaattaagcataatgattccattgccaaggcgttaagcattgctcttaacttccttagccactcattgcacacagtcaaacaagtgaaacagaaaatgagtgaaaaagaggtatctgaaagtattcaggatgaagttgttgcacaattatatgaacaaaaatatatcgatgatttaaattatgcgcaacactatgtttcaacaaaaaaaattattagtcctaagggacccaatgttatcaagatggatttgaagcaggcaggtgttaatgatgatgatatcgaaacagcattatctgattatactcacgaggagcaaattgaaattgcagagaaacttgctttaaaatctgctaccacatacaaaagagaatcaactcgtgctaagaaacaaaaaattgtacaagctttagccacaaaaggattctcttttgatattgcagagattgttgttgatagggtgattacagaaaatgacgatgaaattgagttagaaaatatcaagcgtcaagcggaaaaaagctggcgacgctaccgtaacgaagtaccaagtcaaaggatatataaaactaaaaatagtttgtatacgaaaggttataatgccgaattaattaatgtggtaattcatgagttagaagtatctgcagatgattgaaatgtggtacaattaaataggaattcggtgttagaagagtaggtagcgttatgaacgttgatagacccagtcgtggaccacgagaaggtgacttcatcacgatcaaaagctataagcatgatggctcgttgcatcgaacttggcgcgataccatggtactaaagaccagtgaaaattctatcattggcctaaacgatcacactttggtaacggaagatgatggtagacgatgggttacccgagaacctgctattgtttatttccataagaaatattggtttaacattattgcgatgattcgcgataatggtgtgtcgtattattgtaatttagcttctccgtatgtactcgataaagaggcgctaaaatatattgactacgatttagatattaaagtttttcctgatggcgtcaaacatttactggatgcagatgaatatgcggctcatagtaaaaagtggcattatccaccagaaatcgataaaattttgaaagctcatgtcaaaattttggttgattggataaacgaaggttctggaccattctcacaaggatatgttgacgtttggtatacacgatatcaatatttgatgcaacagcggttaaaagatcgtcgttgagaaaaagcattcgatttgtcgaatgctttttctgatgcatacgaataagttaattcatttatcacacaacaaaacataaaaaaccataatctgttaaaataaaggttatgaaggcattaaaagaacaatatcaaacagcaccgataacgacaattatatttttggtaactacttttgtattcctaattgagcttatattaagccgcggaacgacggagaatagtgaattcttaattaatatgggtgcaaaatggggaccatatatccagttaaaacatgaatactggcgattgttaacgccggtttttctccatgctggttttttacacattgtcactaatatgatcactttatggtttattggaccacttgttgaacgagcatttggcagtgcaaaattttttggactatatttttttggtggtattattggtaatattttttcatatttattggcgccgtcgagtgtttctgtaggtgcatctacagcactttttgccatgtttggtggactaattttgtatgccattcgttttaaagaagatccgcaagttaagtcgatgggaacaatgttggggctctttgtcattttgaatttagtcacaggattttcatcaacggatattgatatatggggacacatcggtggcttaatcggtgggatgatgtttgcggtaatgtttggtttctatgggcgcagtgggaaatacgctattcgagtgcgcttaatcatgggcgctataacaatattgctgattattttaactttttgggcaggtttaagaatatgaaaacattttatgatgtattacaatatttaaaagaattcggtgtgtatattcacgttggtaagcgtctgtgggatatcgaattagcagcactagaagtagataatctctacaaaactgacattttaaatgcaaaagattatgcaacgattaagttaattttatcacatgaacacacaatggaagtcgaaaatccaagtgattgaaaacatttaatgaaaatgatgaaaacgcttgcactatgtaagcactttctgttaaaatatgtaagtaataaattttatggaggaaacatgcattgcgctgattaatcatcatataaggcagttaatttgtctttagaaatacgctttgcactttaataatcatggcaaaagataaacttattggcgttgatcttggtggtacaactatcaagtttgcaattttgactgatcaaggtgaaattcaacaaaagtggtcaattaaaacaaacattttggatgatggtgcacacattgttccagatattgttgaatccattaatcatcatttagacttataccaattggataaagaacgcatcattggtattggtatgggtacaccgggaactgttaaccgtgaaacaggtacagtcacaggcgcctttaacttaaattggaaaacagaacaacctgtcaaagcagatattgaggcaggaactggatttactttgacaattgataacgatgctaactctgctgctcttggcgaagcatggaagggtgctggtaataatgatgatgaagtttcattcattaccttaggtaccggtgtcggtggtggattgttagccaatggtcagctaattcacggtacagttggggccggcggagaagtcggtcacatgattgttgagcctgatggatacttgtgcacatgcggtaatcgtggctgcttagaacaatatgcttcagctactggtgttgttcatttggcacaaaatattgctgaagaatatgtaggtagttcaaaattaaagaagatgatcgacaatggagaagaagtcacatcaaaaattgtctttgatttagcaaaacagggcgactttttggcaaataaagttgttgacaaagtggcttactatttgggttatgccacagctactatgtctaatatcttgaatccatcagccgttgttatcggtggtggtgttgctgctgctggcgagttcttgcgtgcacgtgttgaagaacattggaccaagtttgcttttccaacagttcgtcactctacacgtgtaaagttagcggagttaggtaacgatgctggtgtgattggtgcggcgagtctagctcgaataactgcttaatatgattacaaataaaaaactgctatctcgtagcagtttttttatttgtaatcatttatgctaaattaactgatgcttctgcgtttttttctgatgcatcatcatctgatatatggggtaaaaatgcaggtagcaaatcgttaacagagaaatcagttaagatttgtgtttttaaatcgactgcatcatcaatcgctaccgtagcctgaacctttggcatcataccgtgagctagttgttgatcttctaatatggcctgcatcgtttcttttgaattacggttatacagaaagtctgtgatgttgatgcccacttttttagcaatattgattactaaattacgtgagtatttctgatgaccaaccgttagcgcctcttgtaggttaatgagtaatgctcgcgcttttttattaccttcaatttgagcagctttgaaatcgagagtgagtcgatagactaagctggctttgtctgttggttcatcagcacatgatgaattatcatctttaatcattttcaaaattggttcattgattaaaggcacaaaaaacagatgatgtgaacgatgaatttgttgactaattttttgtagatattgctctgtaattaagcaattatcggacagtggcgtatcgaaatgatatatagatagcatgattgttctcctgagttattaacttattcaatatacaaaatattagtatagtcgtcaagggtgtacttgacaaatgatacgctcataaatatgttaaaatagaatagtagtaattaaaaaaatataataaaggatgacagtatggattgggatcatttttttataccatatattcaaaccgtctcagagcttaaagtaaaattacgtggtttgcgtcagcaatacgaaaaatctggtgaagattcatcaattgaatttgtaactggtcgtgtaaagtctcaagcctcaattgaagaaaagatagttcgtcgacatttagatgagaatcggttggctcttgatttgcaagatattgccggtgttcgtattatgacaaagtatgttgaagacatttatactgtggtcgatttgttgcgtcaaaggacggattttcaaattttagaagagcgtgattatgtcagtaatgctaaaccttcgggttatcgttcgtatcatcttgtgattgaatatccagtccagatgtatactggagaactaaaagtattggcagagattcaggtgcggacaatggcgatgaatttttgggctactgtggaacatgatttacgttataagcatggggagttgaacgaagatttagcaaatcgactgactaaactatccgaatcaacttttgctttagatcaagaacttagtgagataagagcaatagaatgaaaatcgcaattttcaataatcatgctgaacatagcgtgattattgccaaaaaattaatactggcaatgaagaaaaataatgtcgatattgatgatagaaatccggatattgtcgtttccgttggtggggatggcacgcttttgggcgcttttcaaaagtatgttgatcaaacagaaagcgtgcgttttgttggccttcatacaggtcatttggggttttatacggattggttaagcacggagcttgaccagtttgttgatagtttaatccatgataacggccaaaaagttagttacccactactcgagctgactgttgtgagaactagtggtgaatcttacaaatttttagcgcttaatgaagcggttataaagcaacctattggcactttagttgccgacatatatttaggtggccaggcctttgagcgttttcgtggagatggtattgctgttgcaacgccaactggatcaacagcttataataaggctaatggtggtgcagtgctacatccgagcttgccagcaattcaaatgtctgaaatagcctcaattaataaccgagtatttcgaaccttaggttcaccgctaattgtgccacaagatcaagaaattgtgatgaaaccaaaaagcaatcattttttggttatgtatgaccaagaagagattaaagggcacaatattactgaactacgctttaaggtctctgaaaaaagggtccattttgctcaatatcggcatgtggatttttggcgacgtgtacagaatgcctttatcagtgaaattgaataaattaaacagctaattactgtcttgagggacaggattttttatacataaatttgagaggaaatttagtaatagtttgttccaaggtggtgcaagctaaatattatataatgcgaatattgtagtatataatttaagttattgaataagattaaacatgaaatttacttggaaatatagtggtgatgaacagcgtaaagtgcgcacttttttgcaaaatcatggcgtttcgcatagaatgtttagccaaatgaagcataatggcggcgcaatcttggtaaatgaaaaaccagtttatacatccgattatttgatgaatggtgacatcgttacgattgttatgcctacagaaaaaagtaatgacttggttgtaccagattataaaccattagacattatatttgaaaatgaacattggctagttgttgataaaccatacggtataacaacggttccaggacatgctgatcgtttgcatactttggttaatcaagttaaaggacaccttgaaacaattaaggctgatgatttagttcctcatgttgttactcgccttgatcgtgacacatcaggaattgtcttattagccaagcatagatttgcccatgcagttttggatcaacaattacaaaaccatacggttgaaaaattttatttggcttatccgtcaggtattttaccggatgaccatggcgatattaatgcaccgattggtcgcatggatggggattttatcaaaagagaagtccgtgatgatggcaaaccatctcgcacagaatattgggtcgaacgtcgttatgaagatgatgaacaaaatatgactcgtgtgaaagtacaattgcatacaggacgaacacaccaaatccgtgttcattttgccaatatagggcatcctttggtaggggatactttgtatggtggaccagcatggcatggattacaaagacaagcattgcatgcttatcacatgaaattctatgatcccttcattgaggaataccgagaatttaatacgcctttaccagatgatttaaaaactttgagagatatagagtaaacagtggaagaaaaatcagaacaattacatcaaaatatcgctcatctttccgatttattgcattcaggacaagatgaggcctttgtgacgtcattcaacgcgctacacgactttgaaatgggacaagtgtatagtggattaccggaacaattacgtgcagtagcatggcgattgcttgacaatgaaacattagcgactgtttttgataatatagatgttgatgatgaagatattgatgacttattgcaagaaatgccccctcaaaaagctgttcaaattttgcgcaatatgtatgccgataacgaggtcgatcttctccaggaaatgccaacacggttagttgcaacctatttaagcttgatgccaaaagatgaggctgaagatattcgtaagctgatcaattacgaggaacaaactgctggttcattaatgtcaattgagtacttggcagttgaggcagatttgcgtgttgatgaagtgatgcgtttagttaagcaacaagcacttgaagctgaggcgatcaactacgtttatgtattagataaacaagaacggctagttggtgttatttctcttcgtgatttgttaacacatcctgatgacatgttagtttcggaaattacgaaagacagaattatcagtgttaaagctggtgatgatcagcaagacgttgcacaaattgtggctgactataacttcatatccattccagttacagatgataatgaccgattattaggtgtcattacagttgatgatatcgtggatgttattgatgaagaggctgttgaagattattccggattggctgccgttaacgttagtcaaacagatgatacagcatggcattcagcgattaaacgtattccttggttgattgcacttcttttattaggaatgtcaacggctacgctgattagttcatttgatggtctggtacgaaaagcgtcaatattggctgtgtttatttctctgattactggtacagctggtaatgctgggacgcaagcattagcgttggctgtccggcgcttagctgtaggaagtaataatagtgctgtcaaaaatttcttgagtgaaattcttgcggggtttttagtagggacagcaacgggtttctcagtttttctaattgttactttttggaagcataattatcaactgggtcttgcagtgggtatcgcgatggcaattgctattatggtagccaacctagcggggtacttgattcccgtacttattgataaattaggcatggatccggcggtagcaagtggcccatttattacaactttatcagatttaacttcagttctaatttattttaatattgcacaattatttatttcacattttaccggcgcgtaaaactaaaatacgcgaaaaaagcaatagcggttcttatcgctattgcttttttgtttatatgattttaaatattggtttgatttgcttcgcgaagctaccatcagggtcattgacaaatgaagcgtagtcttgccaatatttgtctgataaaataattggttcagcaatattgtcggggatgtattggcgaggaatcgcaccatcctctgtaacggggccatcataactgttgatgaagtcttgcatttttttctcaattacaagtgcttgtggaccaaaccaattatatggctctcgatggatattactttcattaatatcaaataattcatcacgattaatcactgtaaatggatgaaccaaagtaataaatttaacttgaccagtgtcactgacttcggctaatgcgcctgccatttcagacggcaggtttggttgttgatgcgctgttgatgccagaagtagttggcctgcataagaaatatctaaagttatgggttgcccaatgatcattgttaataatttttctggggaaatacttaatgctctcatttttttaatcctgtactgttatgaaatcaaatttttcgaaatcaaataggccttgatcggtaatctttaaacttggaatgaccggtaatgccatgaacgataaagttaaaaatggatcaaatggcacgtcactgatttctgagaaagcttgtagtaattgctggttagttttgatgacattttcaaatggttgatctgacattaaaccgccaattgggagtggtagggtcgtaattttaccatggttaacgacaacttggccaccgccgatttcatgcagcgtatctgctgctaaaatcatgtcgtcgtcgtttacgcctgctataatcacgttatgggaatcatgagcaatagttgaagcaatcgcaccgtcgcgcatgttaaatcctttgatgataccgacaccatggccaagattgtgataacgttctgcgactacaattttagcgaaagtttcgtttgcaacgaacagcccttgctcaacaggaacttcttccacagtgtgctcggtggtgatgtggtgaggtgtgatattgataatatgtgctggtttatcagattggagaggtaaggcgatatcggatttggttaatgagaagtttaatgattggttggctaacggtgtgacaattgattgattgtctttataccaatgaccaccaatcatgacttttggtgtctccaaatgtgctaaatcatcgaatactgctagatcggccacaaatccatctgtcaatgcgccgatattttgtagcttatgcgcttgagcggcattatacgttgctatcgtaaaagcaattgctggatccataccattttcaatggcaagtttcacgctataatcaatggaaccttcactttggatgtcgttagctgttttgtcatctgtggcaaaagaaaagtgtgattgattggccattgtaattgcaggtagtattgctttttcatcacgctcaaccgtgccttcgcgaacaaatatggagaaaccagcatttaagcgttctaatgcttcttttgcattctcactctcgtgatcagtgtcaatgccaacatttcgataaactgcaagttgctctggagttaaaccggcagcatgaccgtcaacatgtcgaccagcatcttcagcatctttaattttttgtaacatatcgggatcaagatttgctacagcaggaaaatccataacttctgctaaaccgttgacttccggcacgctatagaatggctttaaagcatcagcgtgaagcgtcgctccagcatgttcaaaaggtgtagcgggtactgaagaaggtaacatgtaatgaatgtttagcggtgtttgtttagcatcttccaacatatattggatgccagacacaccagctacactggcaatttcatggggatctgcaaatattcgagtgattccatgtggtataaccagttttccaaattcactgggcgtaagtaatgagctttcaatgtgtaaatgggaatctatcaacccaggcacaatatatccgccaccagcatcaaaggtattttcagctgttaagtcacttcgctttccgcggtataaaatttgattatcgttaatccataattctgtatcgtcaaattttaaattaaatacatctagaattttggtatttttgatgtgccatgtaacgagttttgtcacaatatgtctcaccttcaatttttttatatgataccataaactcatattgtatagaagaaatattctaaatagtaatgttgtaccaatcactttttataaggtataccaataattaaaaagttgtttgacaatggcttttaagctgtgtaaaataacacttgtgaacaaaataaaaaataaaaccatttttgaaagtaggactatataaatgtgtggaattgttggatttactagttttaatcaagtgttaccaactttgttaaaaggtctagaaaagctagaatatcgtggttatgattcagctggcgtgtatgtaaatgatggtgaccaaggagactatttggtcaaggaaacaggccgtgtagctgatttggaacgtgctacggaaaataagaatatcaaggggacttcgggtattgctcatacgcgttgggcaactcacggtggtgtatctgttgaaaatgcgcatccccatgcttcagaagatggacgtttctacttagcacacaatggtgtgattgaaaattacgatgaattacgtgatacatatttgcaaggtgtaaaactacattctcagacagatacagaagttgctgtccaattgatagataagtttgcaaaagaagagaacttgtcagcagtcgacgcttttaagaaaatgattgctttactagacggcaattcagcatacgcattcttgttgatggatcgtcaagaacccgggattatgtatactgctaaaaagaaaagtcctttactgattggtgtttcagatcagggaaatgtggtgacctctgacgctgctgctatgttagatataacccatgactttatcgaattgatggatgatgaagtagcgattgttgagaaagataaagtgacattattcaatgcgcaaggagaaccaattacacggttaccattccatctcgatattgatgctgcagaaacagataaaggtgtttatccatactacatgcttaaagaagtggatgagcaagcaattgttactcgcacgctttctcaatattattttgatgacgagaataatattcaaaatatcgatgccaacattattgatgcaatgaaagcggctgatcgcttatatattgttgctgcaggaacatcgtatcatgccggattagttggcaaacggtattttgagcaatgggctaagattccgactgaagtccatatttcttcagaatttgcttatgatcaaccaatgctcagtcaaaaaccattctttattttcttgagccaatcaggtgaaacggctgattctcgtgaagttttggataatattacgaaacagggctatccaaccttgactattgctaatgttatgaattcaacattaacacgagaagctgacttcgcgttacctctactcgccggaccggaaatagcggttgcttctaccaaggcatacacagctcaaataagtgttgaggctattttagcccacgctattggtcattcaggattgaatttgaagcttgaattggcgaaagtagctgttgaaatgcaagtgatcattgatcaaaaagaagattttaaagcaatagcagaaagtgcattatctggacagcgctcagcattttatatcggacgtggcctagacgctgccgtagctgttgaggcggcactcaagttaaaagaaatctcctacgtgcaaacggaagggtttgctgctggagaactaaagcacggtacgatctcacttattgaagaaggaacaccagtttttgcactccttacacaagcgaagacagctggattagttcgaggtgaaattgcacaagttgccgcacgtggtgctaatacaattgtcatagcaaccaaagaactggctaaaactggcgacgcctatattttgccggaagtcaatgaactactgatgccattattggaagtgattccagctcaattaattgcctattacgcaactctagatagagggttggatgttgatcgacctcgaaacttggcaaagagtgtaacagttcaataaaatataaaaatcgatagaaatattcttatcgattttttttgtacgcagcgtttcattctggtaaaatgtactagataccattatgcaaaaaaatattgcatacgaaggaggagcgttttggcgctttttaaaacaaaagagaacaccgtttacgatactacgcaacttaaaattccagagcatattgcaattatcatggatggtaatggtcgatgggcaaagaaacgcttaatgccaagagctgcgggacacaaggctggcatgaatacagtaaagcgcattgcgtctgcagcaagtgatatgggcgttaaagtcctgacactatatgtattttctacggaaaattggtcacgtcccaatgatgaggtcaactttctaatgcagctgccaatcgctttttttaatgatttcgtacctgatttgattaaaaataacattcgagtttctgttactggaaatgttgatgcgttaccagcagcgactcaagatgctgttaatagagcaattgaagagactgccaatggtaccggcatggttttaaactttgcaatgaattatggcggacaagttgaaattgttgatgctacaaaaaaaatagccgaagaagtagccaagggccatttgtcaccggatgatattaattcggaagttttcgctgccgccttacagacagcacacttgggagacttggccacaccagacttgatgattcgaacctctggtgaattgcgcttgagtaattttttgccataccaagccgcttacgcagaattatattttactgatgttctatggcctgactattcttcggatgatctaatgacagccatacaatcttatacaaaacgagatcgacgatttggcggtctcaatgatgaaagtgagaaacaagcttaatgaaaacacgtgttattacagcagtcgttgctttaattatctttgtgccattgttagtaattggtggtatgcctcttttgattttgacgttagccatggcagttgttgctatgagcgagatactacgtatgaaacatcgttttttcgtatctgcggaagcattgctgagctttgttggtgttattgtaattacactaccgaaatcaacttggcaagatatgccatttaatattaatggaagcgtcattttttatattattgtcttcttacttttgctacataccgttttgagtcgtaatcattttaattttgatgatgcaggaacattggcgctgacgattgtatatgttggtacaggattccattacttttttcaagcagatagtaaggggattgctacggtcatgttcggtatgctgattgtatggatcactgattcaggtgcttatatggttggtcgtgccattgggaaaaataaattggctcctaaaatcagccccaataaaacttgggaaggttctattggtggtagcatggtagctattattgtgattccagcattatttaccatcttccattggttgccggattataactttatcgaattgctagcgtttacggccattttgtcaattgctggtcagttaggtgacttaattgaatccggtttcaaacgtcattatggtgtgaaagattcgggtaatattttgcctggacatggtggcatattagaccgttttgattcaatgttaatcgttatgcctatgatggccgtattgggtatactcaattaaaaatgattttgcaagattattagatttcttcaaatcaggtaggtgctaaatttatgaatgttacatcaattattgcttttatatttgtgtttggcgtgctcgttacagtgcatgaatttggacatttttttgtcgcgaaaaaatctggtgtattagttcgtgaatttgcaattggaatgggaccaaaactgctcagttggaagcgaaatcatacagcctatactattcgcatactacctgtaggtgggtatgttcgtatggctggcatggatgaagaacccgatctggatgcaggtcaacgattacgtttgacttttaatgaacagggaaaagtcacaaaaatagatacacaaatagatgaggctgggatcggtgtgcctttccaagttgattcgttcgatttaagtgacgctttgaccctgacgggatattcagacaatgccacagacatgacgactgtacatgttgatcatgatgcaacgattattgaggaaaatggtgttgaggttcaggttgcgccacgagatgtatggctacaaagcgccaaagtatggaaacgtgcgttaattaatattgctggtccagttatgaactttatattagccctggttattttttcaggagtagggtttgccatcgctagtgtgggtttaaatgaacctattattggcaccgttcaaaaaaatatgccggctgatcaagctggtctaaaagctggtgacgaaatcacacaaattgatagggtcaaaacgactacttgggaccaagttgccaatgctattggtaactctaaggaaagtcagctgaacatcacagtgttacgcaatggtcacaaaaagcaggttgaagtgagaccaaaaactgttaaaataaatggtgtgcagactaaacaagttggtatcatcgaaaaaacacacactgataccatttcacgtctaaagtatggtttaataaatacaggtgcgacaattagccaaatatggcatgcattaagccatctatttactggtggctttagcttagataagcttggtggccctgtgtctattgctaaaacaacttcatccgtagcaaaaacaggattcttaaacatattaatatttatggctatgctatcacttaatttgggtattatgaatctaattccaattccagcattggatggtggtaaactcattttgaatttgttggagggtatattacgtcgacctttgccacagtcatttgaaaacgctgtaactatcgttggcgctgtatttatgattattttaatgattgccgtcactataaacgatattttaagataaaaactggtgctatcggcaccgtacataacaacaaaacataaggggaattcatgaaacagtcgaaattattaatgccaacattgcgggatattccagcagaggctgaagtaaaaagccatcaacttttgctaaaagcagggtatattcgcccaattgcagcgggaatgttttcatatttaccattagcaaaacgagttttaaataaaattgaaacaattattcgtgaagagatggataagattgatgccaacgaaatgttggtacccgaagtcttaccagccgagctatggcaacgctctggtcgttatgaaacatacggaccagctttatataagtttaaaaatcgtcaagatcgcgattttattttgggtcctacgcacgaagaaacttttacgcaattaattgctgatgaaattaagtcatacaagaaattaccattgactgtttatcaaattcaggcaaagttccgtgatgaaaaccgaccacgtttcggtctattacgtactcgtgaatttattatgaaagatgcttactcatttagtgctgatcaagaaggcttggatgaggcatttcataatatggaagaagcctacaccaatatctttgatcgactagggctcgagtatcgtgcaatagttggcgatgctggtgctatgggtggatcagattctaaagaattttcggcacctgctgcagctggtgaagatacgattgcttattctgatgcaacagattatgcggctaatcttgaaatggctaaggacttttacgaacgtcgatctgcaacagctgaacagttggcgcttgaaaaaatttcaacccctaacgaaaagacaattgatgatgttgccacacttttggataagccaaagaatgaattagttaagacgattatgttcgttgcagatgacgaactagttgctgttgtgacaactggcgattttgaagtcaacgaagttaaggttcagaattatttacatgctgattctttggttatggctgaagaagtggatgttcgtaaagcagttggtgctggatttggttcattgggaccagttggattaccagaagaagttaagcttttagttgatgagagagcagctgatctagctaattttgccgctggtgctaatgaagatgggatgcattatgtcaatattaactggaatcgtgatgttgacttactcgtagaaaatgttagtgatttccgtacagtacgcgagggtgatttagccatagatggtaagggtaaattacagtttacttcaggtattgaaattggtcatatttttaaacttggtacgcgctactcgaaaaccttaggcgcacaagttctggataataacggacgccaaaccgatgttatcatgggatcgtatggtatcggtgtctcacgtttattgagtgctattgccgaacaaaaggctgatgaagatggcttagtttggcctgctagcgtagcaccatttgacattcatattgttccaattaacatgaaggatgaagaccaagctcgtgtggctgaacagctagagacattgttggtagcgcaaggcatggaagtattagttgacgaccgtaaagaacgagctggcgttaagtttgctgatgcggacttgattggcctaccaattcgtattacagtcggtaaaaaggctgacgaagatgtcgtagaagtcaaagttcgagcaagtaacacaaacattgagatgcgagttagcgaagtcgtggattctgtctcagtactgctaaatgcgtcagaaaaataagtatatttaaaattgccgatattttatcggcttttttactcaagtagaggataaaatgaagttaacgcaacaagaacaattacagcacttacttacgcatattcaactgccagaagaaattcatcattattttgatgacggttgtttgtctcaagttgatgtttcagttagtcaaaaaatgtggctttttcatgtcgaaattgaacagatactgccggtaaatgtatacatgcaatttcagcagtatttacgaactgcgttcactaatatagcagtggttcaacttaagatcaccacgccagtgcagcaagttaacgaagaagttgtcaactcttattggcatctagcgctacaagaatcaagtcttaaccatgcgacaacgcagcaacttgctagcaacacaatactaaagacaattgaaacgaaccactttggtgttgcagtcggcgcatcaattttgtatcgcgcactgactgctgaggttatcgattcaattgcgacagtttatcattcttttggattaccaaaaattaagttgactccaaaattggatgaacaacttgagcaagaaattcaagaaaatgtggcacaacatcatgctagagcgcgtgaagatttgcagaaagcaattgttgccaatgaacaatcaaagcctaaagtttctagcgaaggtgttgcattagctttagggcgtaagatacctgctgatgctgaaattacacgtttagatagtatcgatggtgaagaaaatcgtgtcgttatagaaggatatatttttgcggaagaaataagagagctacgttctggacggaaactactaacactcaaattgacagattattcaagctcgatttctgctaagaaattttcaaacaatgagaatgacgaagctgtttttgacggtttaaagtctggtttgtgggtgcgattaagtggaaatattcaagaagatcaatacgcacgtgaattggtgatgaacatatatgatttgcaggttgtagatcatgctaatcgacaagaagtttatcaaggtgaagaaaaacatattgaattgcatgcacacactaatatgtcagcgatggatgcagttactgatttttcaggcgttgcgaaattagcaaaaagctgggggcaaactgccttggctgttactgatactggtaatgttcagggattccctgaggcatcagctgctggtgcaaaaaatggtttgaaaatgatttatggcatggaagctaacttggttgaggatggtgagcctattggctttaatttagatcaaaccgagttattgaataaagacactatttttgtagcttttgatcttgaaacaactggtttatcggcagtgacagatcgtattattgagttatcagcggttaaaatgcagttgggtaacgtaattgagaagttctcagagtacattaatcctggattcccactttctgagttcaccaccaagttaacttctattaccgatgctatggttgccaattcagataccgaagaaaatattattaaacgttttcgtgaatggtctggaaatgccgtcttggttgggcataatgttacatttgatgttggctttatgaatgctgcctatactcgctataatcaacccattatcacgaatgctattattgatacgttaccatttacacgctggttataccctgattataagtcttatagattaggcacaatcgccaagcgtttcaatattaatttggaacaagcgcatcgcgctatttttgatgcagaaaccactggacatatcgcttggcgattaattaaggaagcacacgaacgttataatttaaaccgacataatgagttgaatgatcgcatgactgaaggagacgcttggaagcacgggcgtcccgtgcatgccactttgctagttcaaaatgcaacaggtttgaaaaatttatacaaattagtgtctcgatctaacattgagttttttgctcgggtaccacgtattccgcgttctatattggaacagtatcgcgaggggctacttgtaggaacgggtgataccagcggtgatgtgattatttctttgattgaaaagggtattcaggaagcagagaaaaaagcagcgtattacgactttatcgaaatacaaccaacggcaaattatcaaccgatgattgagtcagggttaattgcaacggaagaaaagttgcagagtattttgaaagatatggtggctattggagataaacttaaaaagcctgttgtagttactgaagatgtaaagtatacaaacccagaagacaaaatatatcgcaatattttaatcgctacacagcccggtaatccacaaaatcgcacagctttaccagatttgaatttcaagacaacccaggaattacttgacgattatgcttttatgggcgctgatttagcaaaaaagttggtcattgataatacacatttagttgctaatatgcttgaagatattgaacctttgaaaagcggatcttatccaccaaatattcctggcgctggtgatgaattaactgagagaacttatcgaacagctaaacaatggtatggtgagccaatacccaaagaaatacaggcccgtattgatcaagaattgaaagcgattattggaaacggttttgcgccgcactatatcattgcgcaaagattagttgctaagtcagttaaggacggctatttagtcggttcacgtggatcagttggctcctcttttgtagctacaatgtctggaatcacagaagtaaatccattaccgcctcactatcgttctgcacatggagactactttgaattggttgatccgaaagaatatgaatctggttatgatttgcctgaaaaagaagacccaaatcatccaggtgaatttttaattggggatggacaaaacattccttttgaaactttcatgggcttcacaggaaataaagtgcctgatattgatttgaatttttctggtgattatcaaccaattgctcataattatatgaaagttttgtttggcgaacataatgtataccgcgctggaaccattgcgaccgttgctgaaaaaacagctttcggctatgttaaagcttatgagcgcgaacatgaccaacattaccgtggtgctgaaatagagcgtttagcgcaggggatgacgggtgtgaaacgtactactggacaacatccgggtggtattttaattgtgccgcgtgaatatgaggtctacgattttactccgattcagtatcctgcggatgatcaaaagtccctttggcaaactacgcacatggattatcattcaatccacgataatttgctcaagatggatatattgggtcacgatgatcccacaatggtgcgtacattaaaagatatgtctggtattgatccacagtcaatacctgcaaatgacccaggcgtattaagcttatttacctcaactgaagctttgggtgttacgccggaacagattttttccaatactggcacactaggattaccagagtttggtacaaactttgtgcgaggaatgttggcagaaacacaaccgcacacatattcagaattattacaaatttctggtctatcgcatggaactgatgtttggttaggcaatgctaatgaattaattgaaaatggaacagccaccattggaacagtaattggaacacgtgataaaatcatgactgatttgattaattggggtgttcctgctgcagatgcttttaatattatggaaaaggtccgtaaagggaaaggaataacagaagaatatcagaaacagctacgtgaagaaaaaattccagaatggtatatccaatcaatgcttaaaatcaagtatatgttcccacgggcgcatgctgctgcctatgtgttaatggcattgaggattgcgtactttaaggtttattttccaacaatctattatgcaacttacttttctgtacgtgctgatgcatttgatatcgtagcaatgagtcgggggaaagatgccaccaaagctgctattcagaagttgaagtcacttggaaatgatgcaacagttggggataaaaacttattgactgttttagaaatggccaatgaagccttggagcgtaacattactttcgctatggttgatttaaacaagtctgaggcgcttgagtgggtgattgatggggacaccttgattccacctttcgtttctttgccaggcttgggtgataacgttgctaagcaaattgtagctgcacggaccgaaaaaccatttatcagcaaagaagatttaaagaaacgtggtaaggtttcacaaacaattattgagtttatgacattgcattctgttttagatggattaccagatgaaaatcagttaagcttgttcgatttttaattattatgttaaacttttaatacagatatgcagttgttgttcatctatctgttcgtattaaagggagaaaaaaatgaaacatgaatggcatcaaaaagtcgctggatattatgaatatgtcttgaacattatgatgattttgattggtatcgtaatatttggatttttaatacgtgaaatctggaatttagcacagatgctatcgatcaagaatatctcaggacatttcactgaattagctgaacaaatcttaattgtatttttgttttttgaatttttggggataggcagagagtattttgtcaaagatgctcatatttctactgataacttcttgtatattggtgtgacagcgatagttcgtgctatgctggtatatcacgatcaaacttataagaccttaatgctggcagctgcaatatttttattgatttcagcgcaagctatttatcgctatttccggcctaaatacagatcttaaaaactaattattagtttaataattagttttttattttgtgcctataaaataatatgaatcatctatgctattaaacaaccatttcatggtatgataataaaagaaattttatcaaaattggacgggaacatgactaaaaacattgtcgtactcggcagcttgaatgtcgataatattatgaaaatgccacgtatgccactggttggtgaaacgatggcacttactgaagtaacaacagcaccaggtggtaaaggggctaatcaggcagttgccgcatcacgacaaggagcaaatgtttcatttatcggtgctgttgggaatgatgcaaatggacagtttatgagagcaacattactcaccaatggtgtcaatgtggacgcagtgtcaacaaatagtgatgtgccaactggatcagcatacattatgttgcaagagagtggtgcaaacacaatattgattcatggtggggcaaaccaagccttaacgattgaggacataaataaagcgttaattgcgcaagctgatgtgctaatcgcacaatttgaagtgccgttcgaagttattttggcggcatttaaaattgctaaaaagaataatgtgcaaacaatcctaaatccagctccggctgtgtatgaacttactccagaattaatggctgtcactgatattgtgctgcccaatgaaacagaagcgcaattactgacgggcatcaatgttattaatgacgagggtgttttaaaccgagttagcgatgccctacaagcgaagggagtccaacggagtattatcacattaggagaagcgggatcatttatcgctgatggtcaaaaaagatggtgggtacaacctgaaaaggtagacgcacaagatactaccgcggcaggtgacacttttattggtacattagccagcgtcatagcacctgattttagtaatttagatgatgctgtgcagcgggccaacattgctagtgcaatcgctgtaacacgtccaggtgctattccttcaattcctacagataaagaggttgataactattgatgttgcctgaagactttaaaaataaatacaatcggatcctcggtgatgagtatgaagattttttattgagttttgatgaaccggttcaaaaagcgtatcgtgtgaatccgttaaagtcacatcctgtcatcagtgatacagaagatcatggtaatcttccctatggtaaatggggacattttggagctgtcaacgggcattcagtagatcacgttactggtgtggtttactcccaagaaccgtcagcgcaatttgtgggtgaggttgttcggccaaatcctggcgaacgcgttttagatttagccgctgcgccaggtggaaaatcaacccatctagcagcattcatgggacaaaaagggctattatggtctaacgaaatatttttaaaccgcgctaaaattttgagtgaaaacattgagcgtatgggtattaaaaatgcgattgtcagttcacatacaccagctgagctgagttcaaaattacctgctttttttgataaaattttattagacgccccttgttctggtgaggggatgtttcgtaaagatcctggtgcgatagcctattggcacgaacattatccagcagagaacgccatgaggcagcgtgaaatcctcacagaagctgttaaaatgcttcgtccgggagggcagatagtttactcgacttgtacatttgctccagaagaggatgagcaaataatcaattggctcatggcggcgtatcctgaatttagtttggtttcgattgaaaagccggatggcgctaatcttagtgatgcacgtcctgaatggatagacgaagcttttgtcaatggaacaactgagcacagtgcgacgacgacaaaagatgtgatgaaaaaagctgcaagattgtggccacataagctggaaggggaaggacattttgtggcgaagcttgttaaggctaatggtgattacgatgatgtatctgttgtcaaaccgcttaagaacaaaccattagataaacaacaacgtgaaatcttatctaatttttttgaggaagcactgattacatttgatcaaaaagcgaatgaatatgttttgtttggtgaccacttgtatatggcaccaattggtacaccagatatttcaagtatgaaaatattacgtcttggccttgaattaggtctgtttaagaaaaaaaggttcgagccagcacatgcgttagctctggctttaaaccctgatgaagttaaacagtcgtatgaaatgaatcctgaggagtgggcacaatttgtccacggagatgtcattcagacaaggctggacctagacaaaggttgggtattaatgactgctaatggcaatggtgctggatggggacgctacgttaacggacaaattaagaacttttttccaaaaggattgcgatttgttgttaaaaaataaagtgtgtcgggacattttttttaaaaaaacaaggactgaaaatggccttgttttttcttcgcggtcacgtaaaatgtattaatgttagtatctgagaaattgctacactaaacaagattatttacttgaaaacaaggtgaaatgggagaaattatcatgaataggtcaacaaaaatttttactggtttagcagctgctgctgtgattgcaggtggcatttatgcagctaccagtcacaactcatctagctcaaaaaatgcaaataaaagtgctactttaggattggtcttagatgttggtggtgttgatgatcattcctttaatcaatcagcatgggaaggcgcaaaatcttatgccaaggaaaacaatttaaaggctggacaaaatgcagcagttacatattttaatacaaaaagtcagtcagatttaaatcagaattttaatttggctacaaaaagtaaaaaatatgacattgtctacggtattggttactcgttaaaccaatcaatcagcaaatcagcaaaacttaatccaaaacagaagtttgtgctagttgatgatattgtcaaaaaccgtaagaatgtagcaagtgtgatgttccgttcggaacaatcttcttacttagctggtgtagctgcagcaaccaaagcaaaagaaaatggtgaaaaaacagtaggatttattggtggtatccatggaaacatcattgacgcttttgatgcaggatttgaagcgggcgtgaaagcaacggattcatcattgacagttcaaaaacaatatgcagattctttctctgattctgccaaggggaagactattgcggctgctatgtatgcttctggtattcgcacaatttttgcagccgcaggatttgtcggtaatggcgcatttgctgaagctaaggctgaaaatacaaagttagatgcagactcaaaagatcgtttgtacattattggtgttgaccgtgatcaaaaatctgacggatcatatacatcaaaggatgggaaaaaggtcacatcgacgatggcctcttcaattacttcagttggcgatggtgtgaaaaacattgctgataaatataataaagacaagaagttccctggtggtaaaacaatcgcttatggcttggacgatcatggtgtttatttaacaaagtctgaattgactaagtctcaaaaggccgcagttaaaaaggcagaaaagtcaattatcaatggtaaaattacagtaccaaatcatcctaagggttcacaatttaaccaaaacttttaaatactagaagctattcatttgaatagctttttttgtacttagctgttgctatttggtactatattcgttcaagaagtttattggtagcaaagcatttgaccgaaatacttgttataatattaattagacaaatcagggagaaaataagacatggcttttgacaaaactgtaacgatacctggcgataaaacatataaacttagtaataatattaaaaaatatacacttggagatcttggctttattacaaataaagctggtgtacatatattacaccgtgctttagaaccagaaaaagcgctcgataatgctattcaattgaaagtctcaatcaatcaagaactgactggatttaaaatgagtacagtttctgctggagatgttgtccgagttgatattttcaaaaacaataatgctgctgagttggtgaaactttattattttttcgtgaatgagttaattgaacgaggcgttctggaagaaataaatgaataaatttcttttgaagtggttaatgcaggaggcctaagtaattaattatgacaaaattttattttgtacgacatgggcaaactgaatggaatcttgagcgccgttttcaaggtgggcatggtgattctgaattgttaccttcgagttacaatgatatgaaaaaagtgggcaagttcttgagtaaaatcaagtttgaccacatttatgcttcgccaatacgtagggcacgtattactgcgattaacatcgctaaacaactaaaatataaacctgctttatctttgcggtcaaatctagctgaagttggtttgggcgcatgggaaggtgaactagttgctaatgtaaaagaacagtatgcatcaagctttgacaactaccgcaatgatttagataaatttgaaggtaaagaatttggtggcgagggatatacaaaagctgaagcccggtttgttcgttttattaaagcaaccgctaataatttcccagaaagcaatattttaattgtttctcatggtatggaactgtcttttggaataaatggcttactaaagcaaccccgtatgagcattcgtgagcgggggggcttgactaatacatcaacgactattttatcaactactgatggtgagaattttgtgatagaggactggaataataccagttatctgaataagaaacaggatgattcgacaacaatttgatggcatacccggaaaaacaattagataaaataactggcacgttacaaaacgttattttttcatcgacagaatcctattttaaaattttgtcggtacatattgaagaatcaactttagaagattggcaagagccagaaatgattgccactggaacatttgctgacgtccaagaaggaagtgtatacggattttatggccaattggttcgacatccaaagtacggacagcaatttaaagtcgatcattacgaaaatgaactgcctcccgatgaaaacgggttgattaagtattttgctagtggccaatttactggaattggtaaaaaaacggctgaaaaaattgttaatcatttgggattgaatgctgtcaatctaattctagatgatgcaaaaattcttgacggtattgtaaaagcagaaacagctcgaaaactggcgcgtacgttgcgacttaacttaggtctagaacgcttgttccaaattggcaatcaatttggtattggtgcggacattgccggacgtttatatgatcaatacggtaacgaggcacaagacattttaacgcaagatccttaccgtttagtatttgaatttgatggcattagttttaaaaaagccgatgatattggtcataaggttggtgtagataaattcgatgaacggcgtatgcaagccgctgtttacgcaacaattatgaatgtgacgtttcaatatggtcatatgtttttatcacacgatcaactattattgtcggtcgagcaaatgttgcatcaaaacaataccgaaatgtcgaatcaaattcaaaaggccatccagagcttaattgaaagcaatattttggttaacgatgatggccgttattatgcgaaaaggttgtacattgctgaaaaagaaacggctattaacttaaaacgattattaaatacaagttctccattgaatataacagcaaatgatattaatgaatcatttgtgacgcctggacaaatgacgctcgatcagacacaagttgaggcggttaaaactgggttgaaatcacaaattttcttgttaacaggtggaccaggaactggaaaaacgacaattatccgcacaatggtcgccacttggaagaaaatgattcaaaatcgtgcaaagtttgcagacaatactaaagattttctcaaaaattatcaggtcagaatggcttcaccaacaggacgtgcagcaaagcggatgaccgaggtaacgggttatgatgcttcgacaatccatcggctactgggtattgctgatttggatgagccagagtttaatgcggataatcctatcgcaggcggtctactaataatagatgaagcgtcgatgctagacattgaattaacttcaaaattgctagcagcggttccaaatgggatgaaggtaattatcgtcggagatagcgatcaactaccgtcggttggaccaggcaatgtattagaggatttagtgagtagcggagatatcactcatattgaattagaagttatctatcgacaaggccgtgggagcagtattactgaacttgcaacgcatattaaaaacggtgagttaccagcagatttcttagagaatcaaccagatcgttcgagttttatggtaaattcagagcaagcttcgcaagcaattgaacaagtggttgcattggcgattaaaaaaggttacacgcaagacgatttacaaatattaaccccaatgtacaaaacatctgccggtgtaattgccttaaatcaaatggctcaaaaattgttcaacccgcttaaatcaaatcaaaaaagtttgcagtttggaatgacaattttccgaaagggtgataaggtcttacagctagaaaatgacagcgagcgagacgtttataacggagatatgggcaaaataattgctgtccagtacaagtctgacattggcaatgatgataatgaagatcgcctcatcattgattttgatggtaaagaattggcttatcccaaaaaaaatttgaatcaactgtcattagcgtacgctacgaccgtccataaagcacaaggtaacgagtttcaattggttattatggttttgacaaatcattttggtttaatgcttaatcgaaatttattgtatacaggaattaccagagccaaagaggctttgattcttgtgggagaatacaccgcatttgaacgtgcttcacgcacactggtgccgaaaagattcacattcctgcaacaaaggttgagtcacagcaaaactgaagttaatgagcacgatagttcagatgaatcggaaactatccctgaaaaaacacctcatttgacaacaacaatggttattagtagtgcggttaatccgatgatcggaatggaaaatattaccccatatgatttcatgtaatcgttttcatatagtataatgtataatataataatgaatggagaactttatgacaccagcatatgagctatttaaccttggcagtaatgatgaactggcaggtgaaatatcaacaattttaggtgtaccattagccccaattgatatcaaaacatttgctgataatgaaatatatgagcgaattgaaaatactgttcgtggtcggaatgtgtatgtcattcaaggaattacggcgccggtgaatgataatttcatgaaattgatgatttttattgatgcagcacgtcgtgcttctgccaattcaatcaacgtcattattccctatttcggttatgcacgttcagaccgaaaagcccgttctcgagaacctatttcagcacgtatgattgccaatatgttggagtcgcagggcgtaaaacgggtcatgacgatggatttacatgcggatcaggttcaaggattctttgatattcctgtagatcatttgctagccatgccggctttggggcattacttttatgctaatgatttgttaggggatgatttagttgttgttgcgccggatcattctagtgttgctcgtgcacgcaagtttgccaaacttttacatgcagattgggcactagttgaccgacgtgttgatagcgttcgcccagatacaccatatcaaattactggtaatgtggctggtaaacgtgctattttaatcgatgatatcattgatacaggaacaagtatggtccttgccagtgaagcagctgctaatgcaggtgcgattgaaatttatgctgttgctacgcacgctgtgttgtcagataacgcggttgatcatcttgaaaaagcaccaattgatcatgttgttgtagcaaatactgttgaaatagccgaacataaaaacatgagtaagctgaaagtattgtctgtggccgaatcatttgctgaagcaatcagacgcatcaatgtgtttgaaagtattgaggatgtgctgaaaagcccagacaatttggacgtaatgttatgaaaatagtggatctagaatcttttttatctcctgaatgggggaaaacaagtaatggatttgttacaactcaatttggcgcagcgttggaatttatggttcaaggtgcgcaagaagtcactttaaagtttgcaaaaaaatacgagggtctatcgctggtattgtctcttaacggagaaaattggcatgaaattaacgttgaaaataatgtactcaaattatcagtaactgacggacactatattttgttggtacggtctattgctggtaatcaaatgacactatggactaatccaatcacattagtttcgggtcaaattgattctggagagctagccccaattgcaaccaatgtaaattacattacatttattggtgattccattactgctggtgaggaaatgattgaacatgagccacatccagagctaagctaccctgaattgattgctgaaatactccataagccactagctcggattggctatgggggttcaggtttaacgccgagtgctccttttcaggaaccaacggctgttgaggcattgtggcatgttgctccgaatgttgagcgtcctagggtgtcttctgatttagtaattgttaattatggcacaaacgactataattatggtgcaacggtgcaagatttttgttttgggttacgggtgtacttgcttgagctaattaaacgtttccatgatgccaagatagtgctcctagtgcctttcaacggtgcgtttaaaaaagtttttgagcaagagataaaacgcttcgattgttttgttttattggatactacgccgtggaaaatttcgccacaacaagtgcatccgaatattttggagcacgagcgcgtggcaaaactacttttaggaggattgatttaagatggtatatgcagcagatgaacaacgttacgaaaagttaccttatcgccgagttagtgattctggtcttattttaccggcagtttcgtttggattgtggcgtaatttaggtgatcaaatgccacttgaaaattccaggaatgtgattttaaaagcgtttgatagtggtatctttagttttgataacgcatcaaattatgggccaagcaatggcacagccgaagtgacatttggaaatgtttatcgtaatgatttaaaaccttatcgtgatgaattggtgattacgacgaaagccggttatcatatgtggcctggaccattaggcgaattttctggcaagaaaacattagttgccgcgctggatttgagcttacaacggatgggactagattatgttgatatcttttatgcacaccgttgggatccaaacacacgtttagaggaaactgctcgtgcgttagacttgattgtaaaacagggtaaggcgctttatgttggtgtttcgaactacactgccgagcaaacaaaagcaatcactaaaatattcgatgaacttggtacaccatttattggtaaccaagtatcttataacatgttgaaccgcacagctgaaaaggatggtcttttggatgtcttggatcaaaatcatgcgggtcttgtagcctatggaccacttgctgaaggcttattgactgatcgttatctgaaagaaattcctgctgattatccaatccatccaacaaaccaattcttatttaagaacggtaaggatgccttaattgccaagctaaatgctttaaatgcaattgcgcaaggccgtggacaaaaattgtcacaaatggcgctagcttggttattaaaggatgaacgcgttgcaacagtcgtcattggtgcaagtaaggttgaacatttagttgacaacttaaagttttccgataatttagatttctctgcggctgaacttaaagagatccaagctattttagacaaataaatactgaatgtatcaggaatcagttttgtactggttcttttttgttgtccaaaaagaaaccgtttacaatccaaacgttcgacaaattttgtcagatcgtgaaaatacttatcaaaaaacgaactatatctttatttattataaaaatataatttaaaaacatacaaaattgtcaatataattgttaaactatagttattaacaaacaaagaggccagtcatgacaaaagttttgattatcggttctggtgcacgtgagcatgcgctagcacagacatttttaaaaagtccacaagtagatgaagtcattgttacacccggaaatgatgggatgacagatgaccatttacgacgagttgagattccagtgacgaatttaattgaactaagggattttgcaaaccaagaacacgttgatctaacgtttgttggcaatgaagagccgttgacactaggtatcgttgacgtattcacagaagcctccttaaaaatatttggtccaacaaaaaaagcagctcaacttgaaggttctaaatcatttacgaagaacattcttcaaaagtacaatattccaactgcgcaatcaatgaccgtaacttcttttaatgaagcgaatcaagctattgcaaaatttggttttccaattgtttttaagctagatggattggctttgggcaaaggggtcactattattgaaaatgccgctgatgctcaagaatatttggaaaagttatacacgcaaaatgttgatgtcaaattggttattgaggaatatctgaaaggagtcgagttttctgtatttacattagtgggtcaaaacggtgcaatgactcatgcgcctttagcacaagaccataaacgtcgttttgatggtgatgaaggacctaacaccggtggaatgggggcttatagcccagtgaaatggatttcagatcaaattcgtcaggaaactattgaaactttagttaatccaacagtgaaagcaatggttgaagagcacgcgtcatttactggtgtcttatatacaggcgtcatgttaactgaagaaggtcctaaagtcattgaattcaatgtacgctttggtgaccctgaggcacaagtagtattacctcaatttgagggtgatttttatcaattaattttgcagctattgtcaggtgaaaaaccagcgtcacattggcaagaggaagaagtgtatgttggggttgttctagcagcgaagggttatcctgaacgtcctcaaaaaggagcaatcgttcctcaaatcccattagtgactaattatgctggcgtcaaattggcgaacacggtgttgcattcaaatggcgggcgtgtagccactgttattgctcatgacaaaaatgtgaaattggcacaagaaaaagtttataatgtattagataagacaccgatggatttacaatatcgtcacgatattgcttatcaagctgttcaaaaattataaagggaaacaaacatgcaaacagatattgaaattgcccaatccgttgaaataaaaccaattaccgaaattgctactgctgcagggctgcaggctaatgaaattgaaccctatggatacgataaagcaaaaattaatttggatccatctatcgtgcgtaagcaagaattgggtaagttgattttggttacgtcaattaatccaactcccgccggcgaaggaaaatcaacagtaacggttggtttggctgacgcgctaaatttggccgataaaaagacgatgattgcgctacgtgaaccctccttggggcctgtgatggggcttaaaggtggcgcaactggtggtggctttgcacaagtcgttccaatggctgatattaatttacattttactggagacttccatgcattaacatcagctcatgatacacttgctgcattattagataatagtattcaccaaggaaatccattaaatattgatccacgtcgtattttgtggaaacgcgtagtagatattaatgatcgtgaattgcgtcatgtcactgtcggattaggtggaccaacttcaggtgttccgcgtgaagatggttttgacattactgtagcttctgaattgatggctattttaacactctcaactgatttaatggatatgaaagagcgtatcaagcgtattgttgttggttatacctacagcaaagaaccagtgactgttgctgatttaggtgttgctggcgccttaactgttttgttgaaggacgctatcaaacccaatcttgtccaaacactggcacacacaccggcaattattcacggtggtccatttgctaacatcgctcaaggaactaactctattttggcaaccaaaacagctctgaaattagcagattatgttgtaacggaggcgggatttggtgcagacttgggtggcgagaagtttctagatgttaaggtgccgttgcttggtaaaacgccagatacaattgttattgtcgctaccgtacgtgctttgaaacaccatggtggcgttgcattatcaaatttgaataatgaagatgtcactgcgctcaggaacggcttagaaaatttaggtcaacacctgacagcgatgaatcgttatggcgtaccagtgttggtagccattaatcgcttcacctcggatacggaagcagagttacaggttattaaagactacgtccaacaatttggcgcaatagcttatacaacagaagtttgggcaaaaggcggtgcaggggcacaagagttggctgcagctgtcattaaaaaatcagctcaagaagcagattttacaccactatatcaagctgacgattcagctattgataaactaaatactatcgtgcaaacaatatacggtgggacgggtgttgaattatcaactaaggcacaaaaacaattacaagattttgaaaaatatggttgggacaagttgccaattattatggcaaaaacgcagtattcatttacagatgatgctaaaaaacttggggcacctaaagatttcaaaatttatatccgtgaattcgtaccaaaacttggggctggatttttagtcgcattaacgggaaacatcatgacaatgcctggattaccaaaacatccagcggcattggatattgatattgatgagaatggtacaattactggtttgttttagactaaaaaatggccttttggccatttttttattacttattttctggctcgacatggatttcaacgtcaaaaatttggtacgcttcaaataattttttttcaataagttttgtgatggcatgactttctgccacagtcagttgtgggttcattgttacgacaatatccagggcaatgttttcactataagatcgacctcttatctcttttacagcgatgacaccaggaattctgttaactgtcaaacgatactgatccagtgtatgctgatcaaaaccatctgaaagcataaacacactgtttttaaaaatatcaactgccatgttaaggattaatagagaaataatgattgccccagtagcatcaagccatgaaaaatgaaatgaggatgcgaggattgccaacgtggtggctatactagtaaaaatatcactgaggttgtccttagcagctgcaagcaaagctgtgctatgtacgtttttggccaacttctggttgtgtaagtacaaaaagctaagtaggatggctgaaataatgccaacaattgcgctgagggggctaggtgtgactatttgaccacttaggatatttctaaaagcactaaatagaacttgtaacgcaacgattaacataattattgaagtaatcatgctggcgatgttttctgatttccagtgaccgtattggtggtttttatcaggtggtcggcgcgaaaaatgaagcccaatcagcaccgttagtgacgctaaaatgtcagttgaattattgaatccatcagcgattaaggcttccgaatgaccaatatttccaactagcaatttcataatagtgatcagactataggcagtaaggctgataatagcgccaccttcagcggctttaagttgttcatagcgtttattgagcattttggtacctgcatatcaatgatagatacatgtgcaagagttcacttttattatacaatgaaatacagttgttccaccaaatttgactttcatttttggtggagaataagctccttttaacgttgtgcttgaaccgtgttaaacgaacaatataaaggtgtgttatactatatttatgaaaacaggaacagtaaaaatttggcaaaaagaacgtggatatggatacattacacccgatgaaggtggagatgatgtctttgttcattttaatggtattgatatggatggctttaagtcattgattcaaggcgaaaaagtagcgtacgtactggtacaagggtataagtcttatcaagcagcccaggttcgtccactttcggttgaggcagcagacgtttaatggtggcatatcgtgagacagtaacatcgtctaagataatttatgaggggccaatcttcagcgttgaaacgcaagatgttgatctttataatggaaaaaaagctaaaagagatattgttcggcacgtgcctgcaattggcgttttagcttttgttgatgatgaacatattattttagagaaacaatggcgtgccacaattggtgattttattttggaaattcccgctggaaaattggatcaacgtgattttgacgaacctcatcatgcagttgagcgtgaactaaatgaagaattacgtatggcagcgggttctattgaaaaagcgttaggttttgttgaaacagttggtttttctgatgcttatatgcatttatatgttgcgagaaatttaacacccattgaacaagatcaacaattaccacgcgatttaggggagacaatggatttagtaaccatgtcttttagtgaagtgaaatcgttgtttgattcaggaaaattaattgatcaaaaaactgtcacagcctttttgtattggaattacttgcggggttaatttatggataaaatgtcacgtaaagcagccaaaaaagagcaaaaggcgcgtgaaaaagaacgtatcaaagttgaaaaagactacgctagaaaacatccaactcaagttgaaattgtccagccagaaactcgagaagagatgcggttaacacgtaaaggacgttatgaattagggtcagatggtaagctaacagcgaaaggcaaatcaaaacgcttaacgcatcgttacaatgtaattattattattttgattttattaattattgcaacgtacgctgccttttttttaattaactagtaaatttggagaaaaaaatgaaaataggaattatcacgccaatggcggaggaaaagattgcattgtctgcaattcttgaaaatacagaaacaagacagcacggcagcacaacgattacttcaggaacttataaaaatcatgaagtaatgctcactgagtctggtattggtaaagtggctgcaggttctgctgctacagtgatgattgataattttaatcctgatttgattgttaacactggttctgctggtgcattagaccccgatttaaaaataggggatgaagttattggcacacgtattgcgtattcagatgttgatgtgacagcattcggatatgcttatggtcaattgccaaacaagcccttatattacgaagctgatccagcagtggttgctgattttaagaatttgacagcgggcaaagaaggcttaattgtttctggtgatcaatttgttcaagatgatggtaaaaagaaaattttgtcccattttccagaggcattagttgctgagatggaagcagcagcggtagcacaagttgctacacagtttggaaccccatttattgtattacgtggtgtttccgatttagctaatggagaatctaatattgtctttgatgatttcgtagttgaagctggtaaggcttcagcccagttattaatcaactatatggatcaaaagaactaagccgacaggcttttttttgtactgtgaagtcagtgcagtgctagatatagctgatttctatggtagttggtatagaggttagtgtgcaagcaagttaagaataatgtaaaatagaaaatatattaaatttaaggaatataataaaatgattacttcatataaccaaaaatcttgtggggacatacttgttgttacacttgctcctaacgcggaaaaacaaattgtgactactgtcggaaacgtgacacgaataagtaatgctgaaacaggtcaggccactgggtttaacattgctaatgtaggtgccgaattagggattattggagaaaatggtcaaatattcttaaacgaagagcaaataaatattcttaacgccaacatcaaatcagctggatttgatgaaattatgaaggtttcaccttcaaaacttgttattggtttcgttgaaaacctttcgaatcatccagattcagatcatttacatatcacacaaacaaaagttagtgaccaaaaaagccttcaaattgtctctggatcgccaaatatgaaaacagggattaaagttgtggtagctcagcctggaactatgatgccttcaggcgccttgatatgggatggtgcattacgcggtgtgccatcttcagggatgattgtttctggacgagagttacatttaccgggcgctcctgaaaaaccaggtgccttggttttaccaaatgattttggtgaaattggcgatgtgtttgacttcgaaaagggtgcaacgctctatacagatggattagttgatacaaattattaagacaggggaagtacagctcgtgttgatcaattgattaatgcagctgaaagtgttgataagatggtagataaaattagaaacgcacctcatgtttatcgaatattcaatgatgaaagtacaaagtatcggaaattggtgtttgagttgcgaaaaggtgagttacagtatttcacgtttgtgatggagatcgtaaaaaaatgagtaaaaaatattattttattggcatcaaaggtactggaatgggaccgttagcacaaattttgcatgaccaaggaaatgaggtgcttggttcagatattgatacgtacacatatacgcaagctccattagaggcagcaggtattaaaatattaacatttgatgcaagaaatatagatgccaatcaagatgctatttttgtgaggggaaacgcttttaataatgatcaaattgaagtggctcgggcattagaaattggtgtaaccatggtttcgtatccagaagctgttcaagaacaaatatcacaaactacatccatagcagttgcaggagcccacggcaaaacgtccacaaccggattactagctcacgtgttgaagaatattgctcctacctcatatcttatcggagatggtacaggacgaggcgtgcctaactcacaattttttgttgttgaggcagatgaatatcgtcgtcattttaaagattatgccccggattatgcgattttaacaaatattgattttgatcatcctgattattatactggcattgaagatgtaacgtctgcatttgctgattttgctaataatgttaaaaaggctatttttgcttggggtgatgatgagcacttgcgttctttgaaaccctcagcagatgtttactactatggcgtcaatccagaaagagatgattttgtagcgactaatattcacaaatcaactcaggggtcgcattttgacgttgtttttcgtggtaaagacttaggcgaatttgccgttcctttatttgggcaacatggtattttaaatgcgttagcagtgattgctgtatcttatatggaagaggttgaccttgatttaattcgtcaatatttgctgacctatcagggggttaaacgtcgttttagtgaaaagcaaattgctgatattacagtgattgatgattatgctcaccatccaacagaaattacagcgacattagacgcggcacgccaaaagtatcccaataaaaaaattattgccattttccaaccgcatactttttcacgcgtaattgcgtataaagacgaatttgctagcagtttagaagcggcagatcaagtttatctagccaatatttttggctctgcacgagaacaagccggaacgattacttccaaggacttaggatctgaaattagtaagtttggtggcatcattgaagaaaacgacatgagtctgttaatgccatatgaaaatgctgtaatggtctttatgggcgctggtgacattgaaaaatatgaatttgcttatgaaaagctacttggccaattgagaacagacttgacttaatatctatttaatgtgatttctgttataattgatataaccagaattgtttagaatactggaggtaaatagtaatggataattttaatatgaacgctcgtcgtgatgtgacgggtgtagatgagggaatgcgcgcattctttaaacagacatatagctttatgggtatagcagttttacttaccgcagtgacaggctttatagtacaaaacttttttttggaacaagttgctaagttgcttgtaggtaatgttattggtcttttggcactgttgggtattcagatgttgattataacgatgattggtcgtgcaacttttaaaaatcctgctcgtgcttttggcttgttgatggcttttgcagtggttgaaggtttgacgcttggtgtcttgttagctgtttatacaggagcttctgtgatgatggctttcgtttctgcatccgcggttttcggtggaatggcagcttatggtgttttcacaaaacgtgatttaacgggactaggttcgattttgtttggtctgttaatcggtttgctgatagcatcaattgctaatatgtttttctatagtggaatcgtttcgctattgctctcatgggctagtgtcgttgtcttttccttatttacagcatatgataatcagaacttgaaggtaatgtattcacaatttgctggtcaagcagatacaacaggacttgcagtaaatggcgccttgagattatacctagactttgtcaatattttcttcgcgctgttacgcatcttcggcgttgttagtggttcacgcgactaatgaagaagacccatatgggtcttttttttgtgaaaaaaatttagttataaactagaaacaaaaattttaattttaaaaaaataatcacgtataatgaaatagttggtaaaatatgaaaattattgttgaggaatattatgaatttgaatcggagaaaaagcattattttggtgtcaattatcttggtattactggctattgtttttgtgcaagcagcacgttattatcatgatacatatgtaacagaagtcggctatgccaaaacatctgcacatgttcctaaaaaagaaaaaactacagatgataacgggaaggttattgctcattcacatagttatatatacaaatttcattttgttaccaaaaaaggtgaaagaaagacactcaattatgaattaagtggtgaaaatgtaaggccattgaaaaagaatagttttgttaaagccgatattagtgataaacgggtagtaaaaggtccatacatcattagtaagtcaacaattccagataatattattcataagctgaaataatacttttgaacactttcacaaatactgactagtatagtccattgctttcaaaatgttatcgttttaaaatattgtatgtgattttcaactctaccgaaaaatgcacactcttgaatgtgggatcacatgcttacctattgtgtggctcttttttatttagttaaaatgactaacgtttgacaaataaaatgtttcaggtaaaataaatcttatgcgcaaatttaagggagagagtatttttatgacatttacaagactactaagggtagctggagcagtattttcactgtttttcatcagcacttcacctgtgctggcggggactgtgacatcaaatgagtatcaacaatattatcaccataatattgagcaagggcttatgaatgacgtacaaagtatttggcaggattcatcgggatactaccatatttactatttagctgatttgaattataagcatgatgacgatggcacggaatggtatcatgttaagacaaaagatttcgtacattacgagaaactaggtatcgctattccaaagtttcaaaataaatgggaagcagttgcgactggatcagtaattaaaaacacgaataagttcttttctgatttgccaaaaaaagcaatcatcgcttatttcactagttatacaccaacgggacaaaaacaatatgtggcttattctatcgataatggtgtgacctatcaaccttattctgacggagccattatgtctgcatcatctgcaaaagctcactttagagatccatacgtctttttcaataaagaaacgaaaaaaatgacgatgtatcttgctgaagacgataaaattggtgtttatactagtggcgatggtaaaaacttcaactatgtaggtgctacaccattgaacagcggtgctttaaatggtaaggatctgggattgattgaatgcccaaatctaaaaacaatgtgtgatacaactacggggacaactaaaacggtgatgtttttcggtgctaatggctacaattacggtcagactagtggttcttattatatggttgggcaccttgatgataatggtgtatttgttgctgaacagcaaccaaagcgtgttgatgatggttcagattattatgctagtaactattttcaaacatcggataacacgaatatattgtcaattggttggttaggtaattgggagtattcatgcaaaaaaatagttgatgcgaataatgaacaatcatataagttgggatcattatcgttagcgcaccaattgaatttaaccaaagttaatggtgagtacacaatgacatcttcactggttaagccctatgatagtttgacaaaaacagttaaagatacgattaatacaagtcaattatctaaagataacgagggctattatcaactattggatacccaacgctggacaagtcaaaacttctatgtacaaatgacaaataaaaagaaggaaactgtctgtggaaacattcatttgtcattcaagcaaaaggattcaaccattgacttaaattataatgcagataccggatattacacggtatcacgacaaacaaaaaatatcgctgatagtgatgcaaatactgaatataataaaaaatttgtcgaacaaagcggtgtcgttaatccaaatgtgttcaagctacatgtatacacggataaaacaagtgttgagtttgaatttgaaaatagcggacgcacttattcattattaaagtattcgacagaagaaaatttattatttaatattgaaactgacagtgagaacgacttgttttattcgatgagcaatattgataataaataatctttgctaattagcagcatttttaactaaataaaaaagcacgtagaacttttagctggtgaatttggctaaaagttttttatctttttgactagtaacaacataaaatgcgtgcaaaaactggttcataagaaattactatacttaagtgatatatcaacgtgtgttacacttaatatagataaatataagatgggacattaagatgaccaataaaaaactattacttattgatggcaattcgctggcttttagagctttttatgcgatgtacaatcagttagatcgtatgatctcgcatgaaggattgcatacaaatgcattagtggcttttaataactttttagataaaattgtagatccaatggctccagatttagcattagtggcttgggatgctggttctggaaaagaaacgcatcgtgggaagttatttcctgaatataaggatggccgttctaaagtaccagaggaatttaaagaacagtttccatatttacgtgaaatggttatgttgcatggattgcggaattatgaacaggctggattagaagctgacgatatcattggaacttattcacgtatgggtgaagcagcagggtattctgtcattattgtaactggcgatcaagacttgacgcaattagccacggaaaacgttactgtaaacgtgactaaaaaaggtgtaacagatattgaaagctatacaccagcttatataaaagaaaaatttgggcttacaccggatcaaattattgataagaaggcgttaacgggcgatacatctgataattaccctggtgttacaaaggtcggtgaaaagacagcattaaaacttcttgccgaatataataacattgataatttgtatgataatatcgataaactgaagcagtcaaaaatgaaggacaatttgatcaatgatcgtgaattagccttccaagcacgtgaattagctacaattttaactgatgctaacttacctttaccgcttgaagaaatggaatatagaggtgtcgattttgagaagattattccattctatgaaaatttggatttcaaacaacatttagcgaaaataaaagcattacgtaaatctgggcagcttgagaatacaaaagaatttgataatggtataaattttgtcgaattaaaagaaaataatttaagagcaattgcgatgctaggtgataagatatcagttcatattgaatttgtgggtgataattatcacgagggtgaaatgattggtttcgccattggtaatccagaagttggctactatgctagtcgtgacatctccttgttacaaactgaagagttgaagtcggtgattgagaatgagcagattttaaaaaatgttttcaatgttaaagcacagcttgtattatttaagcgacttggtttggcacttaagggcgtgaattttgattttatactggttgcatatttgcttgatacggtagctaatgataatgttttgtccactttggcacagcgttttgatgtttatttggcacctgatgaagatatttatggtaaaggcgccaaattcactgtgccaaccgataccaatcttttattgtcgcacattgctcataaagcggatggacttttcaaattagaaaaaccagcgttcacagaattaaagcaacacgaacaaacgcacctatatacggacattgagctaccattagcgtttgttttagctgatatggaatatcaagggattaaggtcaatcctgaatacttacgaaataaaggcaaagatttatccgaacgaatagctgatattcaatcagccatctatattgaagctggtgaagagtttaatctaaactcaccaaaacaattaggggtattgttgtttgaaaaaatgggtttacctgtaattaaaaaaacaaagacaggctactcaacggctgtggatgttttagaaaaactagcaccgcaagcgcctatagttgaccatattttgcagtatcgtcagctggcgaaactaaaatcaacttacattgacggcctgctttcagttatatatcctaaggacagcaagattcacacacgatttttgcagactttgacacaaactggtcgattgtcatcagttgatcctaatttgcagaatattccaatgcgttcagaagaagggcgcttaatccgaacagcatttgttcctagccatccgaattggcaaatatttggtgccgattattctcaaattgaattacgtgttttggcccatgttacgggtgataaaaacatgcaaaaagcctttctaaatggcgaagatatccatgccgaaacagctcgagctgtctttggcttagccgatgatgcagtagttgatccacttaagcgtcgtacggctaaagctgtgaattttggtattgtgtatggtatttcggattatggattggctaataatttggggatttcacgtgccgaggcgaaacgttttattgatacttatttccaagagttccctcaaattcatgaatggatgaatacaattaagacttttgcacatgaacatggttatgtagaaacaattgcccataggcgacgttatttgccagatattcaagcaaagaactttaatttaaggtcattcgctgaacgcactgcgatgaactcgcccatccagggttcagcagcagatattatcaaaattgcgatgataaaggttaacgaggctttacgagagaataatttacaggcgagaatgttgcttcaagtacacgatgaattgatttttgaaacccccgtagacgaaattgatgaattgaccgaagttgttacgaatgttatggattcagccgttgcattagatgtaccattgaaagttgatgcacatcatggtgacacttggtacgatgcaaagtagggatcacaagaattcaggtgaggacggattattatgatgataaaattgccttcagtattagcagtggcgtctagtggcgacatgacagtatggcagatcatgcaaaaaatagggatatatgttgcaatttttgtgatgatctttttgttagttgctgctagtcaactcgtaatttctagactgcgtcataagaagtttagtcatcatcatttgttttatgatgcactgtttgttacaagtttcatctcgttgcttgtccttggaggttcttacttataccaaaaaaatgtggcgggcatcaaaacagttattttgaaaccaattcatgaacaagaacgcaaaacggctaataaaaaagcatcagaagatacaacttcgcgcgccctgattcgaaaaatggttatgcgaaatgcaacaaaaaattttgagaaacaaggatttgtatcaattccaagtacaaatattttattgccaatttataatgatgcctatagtgatgaaggactgaaccttggtgcaaattacgcgaataaatctgaaaaagatccggaggggaaacaaaagccagttatgggacaaggaaactatgggttggcagcccacaattttaatgatggtcagactggatttagcgcgttgcaacagacaaccaataatgattcaccgtatttgcaagatggcaaggtgaagggttcatcatggttaaacgggaaaagcgttttgttggctaatagcaaggggatttaccaatacgaaattactagccaaaatacagttgcatcaacagaggtatcagtgttaaacccaactaagaaagcacagttaacaattattagttgccttttcccatcaacggcatatcgaattattacacatgctgaattgaaaaaaacatatacgtggcataatgcacccgaaaaattggttagtgaatttaatttgaaagtacgcaatactaatgcccgtgtgagttggtggaatccaggaatagaagaaggcgcaaatggtgatgctggtggaacaaaataaattgaattgactgaataaaaatggtttcagataatgaaaccattttttgataaataaaattcattaccatttatttatacagtgaacagcgctataataagcgaaagcataaaaatagtgtcaaaaacttttcattacataggaataaaaatgatagataaacaaaaacgtaaggatacctcactaatatttaagcgacaatttttcgatgtgaaagcacaagaatatttgcctatttctgctgatgaattattatctcagcacttgctaattactggtgttactggtagcggaaagtcttcgactgcgctaaccattatagaagaactcaaaaagaatcagcagaatgttattgtattagatccaacaggtgaattccgtacaataccaaatgtacagcgtatcgtgttgggggatgatggtttctttgatgttactcacttgacgagtgatcaaattgctcatctattaaatattacagatgaatcgctgctagccaatttacccgctgcaattgaaagtttgcaaatacaaaacaatgttgtagcaaaaccaggaatctataaaaagatcaatagaagccaaattgaacatgataacctagtggagcagcttaaaattaaggataaatactttgatttaagcttgctggctaatcagttgcaagaagaatttattacgccttatgttgatgagcgtgctgatttttcattattaggacaaatttatgataaggaagccattgccaaagcatggtcaagtcttgctcaattaaaacaaaccttaaaaaataaacaaatacgtactttattgttaagatcaacgaaacaagaaattgtgcactatgatgtcgattatttactgcgattgtttataacacgtcgggcgacgaaacagagtttgatcatcgatttatctttgtttagtcacgaacaaaaattaaatcaagtacttgttgaaattctgactctgcagatgatgagcatagcaaaacttaatggactaagctttcctgtaacaatctttattgatgaagcacatcgatacttgtctaatgatggtcatggcaattacggcatcttttcgttaattcgtgagggacgaaaactaggattggatttgatgctgagtacacaaagcccattagatgttcctgttgagttactcgggcaatttggtagctttatcgtgcagcgattaaacacacgaaatgaaatgaaaaacttattaatcatcaaagaggacctaattgaccaagtagcacatttagcaactggggaggcgcttttaaaaacaattggtcgccaggagttgaaaaaggtcaaagtggaactgagtacaattagccatcaaaccgaaaatattccatttggtctataactaaacttaatgttagaaaacctgacacataatttgcaaaggttattaatttcgtttagaataaaagtatcttaagcggaggtattgtgatgagcgaacgcgaattgagacgtaatttatcaattttaccaattggtactgtacgcgagctcacgttattgactgatcgtcagattagatactatgaacaacagaaattaattgcgccgggtcgcggcaaaggtggccagagacgtttttcattaaatgatgttgatcgtttgctcgaaattcgtgatttcttggatgctggagactctatcaaggatattcaagaaatttttgccaagcaacgccgtaaagcacaagaaaaacaagattcagaagcagcactacgccgttcactacaaaaagaattcgcccaacttggacgattcggggctcattaagaaaggacaatcatggctcgcaaaacttttaccaaagaagaaattaagcaaatcgtggcagacgaaaacgtggagtttatccgcgtaacatttacagacgtcttgggcgctattaaaaatgtcgaagtgcccacatcacagttagataaagtgttagataatgatttgatgtttgacggttcatctatcgaaggatttgtgcgtattaatgaatcagatatgtatctacatcctgatttgtccacattcatgattttcccatgggcgactgacggacacggcggtaaggtggcacgattaattgctgatatttatacagcggatcgtgaaccatttgctggcgaccctcgtcacgcactacgtactgtgttaacagaagcacgtgaagctggatttacttcatttaatgttggtactgagcctgaattctttttgttcaagcttgatgaaaaaggaaacccaaccactgaattgaatgataagggtggctactttgatttggcacctttggatatgggtgaaaatgttcgtcgtgaaatcgtcttgacattggaaaagatgggctttgaaatcgaagcagctcaccacgaagttgctgaaggtcaacacgaagttgattttaagtatgcatcagcattggaagcggcagataacattcagacatttaagctcgttgttaaaacaattgcgcgtaagaatggttactttgcaacattcatgccaaaaccagttgctggcattaatggttcaggtatgcacacaaacatgtctttgtttactaaagaaggcaatgcatttgaagatgtttctgatgaaatgggactttcaaaagcagcttataacttcttgggtggtgttttggaacacgctacagcctttacagctttggcaaatccaaccgttaactcatataagcgtttgacgcctggctttgaagcaccagtttatgttgcttggtcagcttcaaaccgttcaccaatggtacgtgttccagcatcacgtgggcaatcaacacgtttggaactgcgttcagtagatccaacggccaacccttacacatctcttgcagcaattcttgcttcaggattagatggtattaagcgtgagttggaaccattggcttcagttgataaaaacatttatttgatggatgaaattgaacgtgagcgtgccggtattacggatttgccagacacattgttggcggcagttcgtgaacttgcagctgatgacgttgtccgtgcagcgattggtgaacatattgctgacaaatttattgaagcaaagaagattgaatatacatcatatcgtcagtatgtttctcaatgggaaacagattcatatttagaaaagtattaatctcgtagaagcagaaatgcttcttttttattgctcaaaattttagacgaacgttcagttttaatgtttttgtaaacgcatacatcgctaacgttcggataaaaacaaataaatgtcaaaaacgttcgttatatacgaactcttttttgattattgtgaattttcttattttaaaacgaacacaaatgtataaaaatctgttaaattgtaattgtaaacgaacgataaccttgcaaatcacaaaaattgtacacattggagaaaaatatgcctcaagttgcagttgtcatgggatcaactagtgattggtccagcatgaaaaaaacgacagaaattttggatatattaggtgttacttacgaaaaacacgtcatttcagcgcatcgcatgcctcaagaattacaagcatttggcacacaagcaagagacaataagattcaagtaattattgctggtgccggcggcgcagctcatttgcctggtatgctggcagctaatacaacgctaccagtcatcggcgtgccgatgcaatcacgggcactaaatggactggattctttactctctattgttcaaatgccagcgggggttcccgttgcaacagttgcaataggtgatgcaggtgcaaaaaatgcggcaattctagctgcacaaattattgctttaaatgataatgacgtattgcaggccttgaatgaatatcgagaacgccaaacaaagacttctattgaaagcgaggcagaattgatatgacgggagtaattttaccgccggcaacgattggtattattggtggtggccaacttggtcaaatgatggctctttctgcaaaagaaatggggtaccgtgtcggaattttggatcccacgaaaggctctccagctgggcaagtatcagattttcagatagttgctgattatgatgatgtcgaagcattaaatgaattatcacgacgaagtgaagtgttaacatatgaatttgaaaatgttgatcgagatgcattgaatgagcaaagcgatgcagaattgccgcaaggtacagaactactaagaattacaagcgatcgcattactgaaaaaaagtttattcgggatgatgctaaagtaccagtcacaaatttcattgaagtaaattcacccgaagatttacgaaaggtaactttaccagctatcttaaaaacagtgagtggaggatatgatggccacggtcagtggtcaattaatacagtgcaagatattgttaatattgaaaaagattttccagatacgcaattaattttagaacaagttgtgaattttaaacaagagctaagtattatggtttcacgttcccaagatgggcaaattgtgacctggccgattgtcgaaaatgttcatgaaaatcacattttaaaaacgacaacagcacctgctgacatctcattgacactcaagaataaaattgaagcaattgctgagaatatcgctgagtcacttaaattgcgtggcgtacttggtattgagttatttgtcgctgacgaggaagtatgggttaacgaattagcaccgcgaccacataattctggacattatagtattgaagcgacaaatgtatcacagtttgaaggacatgttagaagtattgtcggtctacctataccaaaaattgagttgcaaagccctgctacaatgttaaatttgttgggcgatgagttaacacaagctagagaagatttaattcatcatcctgagtggcattttcacgattatggtaaattggctgttaaacttaatcgtaaaatgggacatattacggtactaggaacagaaaatggtcgaaaattaaaagaatggggtgacttgcatgagcagcgcaactgaatacgaagacaaaacagtgactcgcggagaactgaaatatcaaggcaaggcgaaacaagtttatttcacagataatcctacaattttgtgggttcattatatggatcaagcaacagctttaaatggtaaggtacatgaaaatataccagaaaaaggccaattgaatagtgcaatttcgcatatattatttgaacatttaacacgtcagggcattgaaaatcattatctttcttcggtttctgaaacagacgaattggacttagcccttgagattttgcccattgaagtggttacgcgaaactacgcatcagggcattttgtaagtaaatttaacgcaacgccaatgcaaaaattaacaccagttgttcaagaattttactataaatcagacgagctggatgatcccttcatgaatgattctcaaattttagctcttggttttgccacattatctgaactcacaaaattacgtgcttatgcccaagaagttaatcaagcgctcacagaaatatttgatgaaattaatattaacttagtcgactttaaattagaatatggtcgtgatagtgagggaaagttaatcttggctgatgaattgtcaccagataatatgcgtttggtcgaccaaaaaacaggtaagtcacttgataaagatgtgtttcgaaaacatgctggtgatgttactgttggttatcgtgatgttctatcacgtttagaaaatttggagaaataatatgtacttagcaaaaatatatgtcacatacaagccatcaatccttgatccacaaggtgaagtgattaaagctgcgttaaatcgtatggattatagcggaatcgagcaagtatcacaaggaaaatattttgaaattaagctgaaagcgaccgatgttgatgctgctacttcagaagttgaaagtttcactgatgccctattaatcaatcaaaataccgaaacctaccgctttgatttatctttggtagatgaggacgaggtactatcatgaaagctgcggttattagttttccaggatcaaattgtgattttgacatgttacatgcattgcaagaatttggtgttgacgcagaaattgtttctgcaaaacataataatttgaaagcatatgatgcaatctttttaccagggggtttttcatacggagattatttgcgtacaggagcgattgcccgtttttcaccaatcatgagtgctgtgacacaggcggctaatgatggcaagcttattgttggcatttgtaatggatttcaaattttgacagaagctggtttgctacctggacaactattaacaaataaaaaaccaggatttatttgcgatgagatagcactttcaattgcaaatccaaacaccgcttatacaaatgcttatgattctgaagaaataattaatattcctgtggcacatgcagaaggaaattattatgccgatgcagaaacattgacgaaacttgaagaggataatctgattgttttccgatatgtggataatcccaatggatcagcacatgatatagcggggattatgaatgaaaatggtaacgtctttggtatgatgccacacccagagcgtgcagttgatgcagtgactggtaacgaagatggtaagaactttttcaaaagtattttgagcggcattctagcaggagcctaatataatgacaacaaatgaattatcacccgaagaagtacgtgacagtaaaatttatatagagtgggggcttacagaacaggaatatgatttgattgttaaggagttaaagcgtctacctaattttactgaaacaggcattttttcaggaatgtggtcggaacacgtttcttataagaaatcaaagccaattttgcgcaaattctggtcatccaacgaacgtgttttacagggaccaggtgaaggggctggaattttagacattggtgacaatcaagcagttgtttttaaggctgaaagtcataatcatccttcatttgttgaaccgtatgagggggcagcaaccggagttggcggtatcttacgtgatattttttcaatgggtgcccaacctattgctgtactggattcgctacgttttggtgaattggacaatgcgcatacaaaacatattgttgacggtgtcatagcaggaattgcgggatacggtaatgcgattggtattcccacagtgggaggcgaaattggtttcgatggcgtttacgctggcaatccattggtaaatgttatggctgttggcttgatggaccaaaatgctatgcaagttggacaagctaaaggcataggaaattcaattatctatgttggtgctaaaactggtcgtgatggtattaatggcgcctcatttgcttctgctgagttctcaagtgcagaaaaatctgatcgttcggctgttcaagttggcgatccattcttggaaaagttggtgatggacgcaacgctccaagcaatacgtgaacattctgatattattgttggcattcaagatatgggtgcagctggactcctatcctcgagttctgaaatggctgctaaagcaggcatgggtattcacttgaacttggatatggtccctcaacgtgaaacaggaatgacgccatatgaactaatgttgtcagagtcgcaagaacgcatggtgctggttgttaaaaagggtgaagaacaagctattattgacttgttccaatcggctgatttagatgctgtaatcattggtcaagttaccgatgatggtcgttatcgattaaactttaaaaatgaagtagttgcagatgtgcctgttgatttcttaacgcatgcgccaaagcaagacttaccaatgattgaaccggcaagattggcgaactttacagatgaacaatttgagccagacatgggtaacgtcaaagaaacaatattaacattactcgcacaaccaacaattgcttctaaagcatcgttgttccgacactttgattctcaagtgcgcgctgatacggttattaagcctggtggagatgcggcgttgattcgtattcgtgatacgcaaaaggcattagcgatgacaacagatgtcaatgctcgttatttatatctcaatccacgtgtgggtgccaaaatggcagttgctgaagcggctagaaatattgtatccacaggggcaaagccaattggcatcacagatggcttgaactttggttcaccggataatccagaagtttattatgagttggatcaagctgttgctgggattaatgacgtggctaaacagcttgacacaccaattatttctggaaacgtgtctctttacaacgaaacagatgggcaagcaatttatcccacaccaatgattggcatggttggtttgcttgaagatatcacaaaagcaacacgaacggcatttcaaaaagcaggcgataacatttatcttgtagggcgaacgaaagatagctttaacggttcagaaattcaaaagatgcaaacaggacatattgccggtcaattatttgattttaatgatgaggacgagttagcagcgcaacaggtcattctagatgtcactgatcaacgtctgcttaatagtgcgcatgatttatctgaaggtggattaatcgttggtcttcttgagagcgcctttgctggaaatcttggttttgatatctcggtagacttagccgataagtatttattttcggaaacaccaagtcgttttgtagtcagtgtgtcacctgaaaataggacaacatttgaatcactagccggtgaccgagtaataaaattaggtgtggttacagcagatgatacgattaatattacaacgacaacaagcgatattcaattgtcattaagcgaaacgaagaaaatctaccaggagagtatcgcatggaaactaaacgcggagtaacgatgatgaacgaacaaaaaaatgaaacatcacgtcttaatgtgcgtagtttgaatgaagaatgtggcatttttggcgtctggggtcgatccgatgcggcgcaattaacatactatggactacatgcattacaacatcgtggtcaagagggtgctggtattgttgctaacaataatggtcatttgtggcaagaacgtggtttaggtctattgagtgatgtttttcgagatacatctcgcattgaagcattagctgggaaaagtgctattggtcatgtgcgttatgccacagctggatctaatgggttagaaaatatccaacctttgatggtgaattttcatgacatgcaaatctcattagcgcacaatggtaatttgacaaatgcccttacattacgtgaaaatttggaagaagaaggggccatttttcaatcatcttctgattctgaaattttattgcatttaattcgccgatctaaagcagacaaatttattgataaactaaaagaagctttaaacattgtacatggtggatttgcgttcttgctattgacgccacatggaatgtttgctgcgttggatccacacgcgtttcgaccttttgtcattggtcaaatgccggatggccactacattgttacatctgaaacagctgctattgaagttgttggtgccaagttcgtacgcgatgtacaacctggcgaactaatcgcgatcgacgacaatggtttaaccatcgatacatatactgataaaaccactttaaatattgactcgatggaatatatctattttgctcgccctgattcaatgatttatggtgtgaatgtacacaaggcacgtaagcggatgggggcagctttagcagcagaacagccggttccggaagcagacattgttgttggcattccgaactctagtttgagtgcagccgctgggtttgctgaagccagtggtttaccaaatgagatggggttagtaaaaaatcaatacattgcgcgtacatttattgaaccaacacaagataaaagagaacgagccgttcgtatgaaattaagcgctgttcgtgacgttgttgttgataaaaatgtcgttttgatagatgactcaattgttcgtggaacaacatctatgtttatcgtgcgaatgctgaaagaagctggtgctaaatcagttcatgtaagaattgcgagtcctatatttaaatttccgtcattttatggtattgatatgcaaacaacagaagaactgatgggcgcaaatcattcattgcttgaaatgacaaaaatgattgaagctgattcacttggatttttgtcagttgatgcactggttaaggcaattgacttaccatatgatggagaaggaactgggctaacgaccgcttactttgatgggcattatccaagtccaatttatgattataaagccagtttagaccaatttgttcgttctggagaagttgatttcgttcctgaaccagtaaccacttatcatccccgtcaagtggcttcattgcgacatcaggagcttttgtcagatggcactatccatttagattcacaaacaattcagggggtggaaatatgagtgagaaaaatgcgtatcagaaagctggcgtcgatatcaaggctggagaacgtgctgttgatttaatgaaagatgcagttgcagatacatataatgaccaagtgcttgacggtattggtggttttggcgctgcatttgctttaggaaaaggatacactgatccggttttgatttcaggcgctgatggggtaggaacaaaactactgttggctatcgctgcggataaacatgatacaattggacaagatttagtagcgatggtggctaatgatatcttagctcagggcgcaaagccagctttcttactggattatttagctgtggacaagatgagaccagaagttgttgctgaaattgtcactggcattgccaaagccgccaaaacatcaaatatgtctctaattggtggtgaaagtgctgaactaccaggattgtacgcggaaaaacattatgacttagcagcttttgctgttggtattgcagagcggcaacaattattgtctgcaaaaaatgtctctgaaggagatgttttgattggtttgccatcttctggaattcactctaacggctattcgctagtacgtcaggtttttggtgttcagtcggatgacgactttaatcaattatctcctgagaccaaggcaaccttactgactccaacatctttatatgctcaatctgtttggccgcttgttgcagccaaccttgtgcagtccatggcgcatattactggtggaggaatcatagagaacttacctcgagcattgcccgataatgtttctgctgaaataagctggggttcatggccgattttgcctattttccacgaactacaagctaaaggacatttatctttagaagatatgctattgacgttcaataatggattaggtatgattctgattgtaaagccacaaaaattagcagatgcaatgaccttattaactcatcaaaatcaaacagcctacgtgcttggtaaaataacgcctgctcagaacgatcgagttgtctttacaggtaatgaaccatggtgagaaaagtaaatttagcagtttttgcgtctggtacggggaccaactttcaagcattaaatgatgctattttacaaagaaatctgaatgctgaaatcgtacgtttgattgttgataaatcaactgctggtgccctgaatttagcaaaattattcggtattcctgctacagcaatcaaatattctaattatgaaacgaagaccgaagcggaacaggtcattattaatcaacttaaaacagatcaagttgatggtattttattggctggttatatgcgtattttgacgccaaagttaatcgatgcctattcagggaagattattaatctccatccggccatgctgcctaaatttccgggacgacacagcatcctagatgcctttgaagccggtgtttcagagaccggtgtaaccgttcattttgtggataatggcattgataccggtgagataattgctcaagaagctgtcccaattttggtgaatgataccattgatttacttgagacacgtattcataatgttgaacatgtgctgtatcccaacacacttgcaaagttaatagatgaaggagtatttttaaaatgacacgagcattacttagcgtttctgataaaagtggtttaatcccttttgccaaaaatttagttgaattaggttatgaattggtatctactggcggtactcataaagtgttggtcgatgccggtttagatgttatttcaattgatgaagtaactgattttccagaaatgttggatggccgtgtaaaaactttacatcctcgtgtccatgctggtttacttgctcgtcgtgacttaccagagcacatggctaaattagcagaatttgatatcacaccgattgatatggtagttgttaatttatatcccttcaaatcaaccatccaaaaagaaggtgttactgaggaggaagcaattgaaaacattgatattggtggaccctcaatgttacgttctgcagctaaaaattttgcatcagttttgccaattgtggatccaaaagattatgatgttgttgccaataagctaaaagctggtgaagtggatcgtgaatatcgtaagtcattagccgcaaaagtgtttcaacatactgccagttatgatgccttgattgccaattatttgacggaaacatcatttcctgaaaatctaacattagcttacgaaaaatttgatgatatgcgttacggtgaaaatcctcatcaatcggcagctgcctataagacagccttacctgaatcttattcagttttgaatgctgatattttacatggtaagcaattgtcatataataatattcgtgatgctgatgctgcccttagaataattgctgaatatgaagaaacgacagttgttacagttaagcacatgaatccagctggaatagggcagggacaaactttggaagctgcttgggatcaagcttttgctgctgatgatatttcaatttttggtggtattgttgcgcttaatcgtgaagttgacgcagcaactgccgaaaagatgcatgccattttccttgagattattattgcaccaagcttcacaccggaagcatatgaaattctagcagctaagaaaaaccttcgtttgctaacattaccatttacaacaagtattccacaaaaattggaagtcacttccgtattaggtggggtggttgtacaagagcgtgatttggttggtgagtctgaaaataattttaccgtggtttcaaaagcacagcctactaaagaacagttacaggcaatgatttttgctcaaaaagtagtgaaacatgtgaagtcaaatgctattgttgtcgctcgtaatggtcaaacattgggtatcggtgcaggacagccgaatcgtattgattcagttgtttactcaatccaaaaggcagaaaaaaagccagggtttgatgaagcagtattagcttcagatgcatttttcccaatggatgattctgttcagtatgcagcagaacatggtattaaagcgattgttgagcctggtggatctataaaagacaaggattcaattgccaaggctgatgaattgggcgttgtcttaatcttcagtggaacacgtcactttaagcattaaaatactgacaaaaagcgctgtttagagcgcttttttagttgaatcacattatttttttaggtatacttatctatacgaacaaatattcgcttaggagattatatgaaatttattcatgcaggtgatgtgcatcttggcaatcctttttctggtctggataaacagttgccatttactctaaaaaaaacagttcaaacagcaacaattaaggcatttgagcaattaattgatgatgctatttctgctgaggttgattttatcttattcccaggagatttatataattcagcggagaatagtccatttattcaagaagtagtgagcaaacaattcaaacgactttcagatgtgaacattgatgtttttttaagttttgggaatcatgactttgaagcagatacgagaaatcatctgccctggccaaacaatatccacgtttttcatcaagaagtagaaacaaaaattaaaatacttcattctggagaaaaagttgcgctgacgggctttagttaccaaacccaacgtcaaactgaaaaaatcattgatgattttcctagcaagggagatactgactatcaaataggcttgtatcatggtgcacttggtgtggctggtgatccttatgctcctttttccttgagtgatatgttgcaaaagaactatgattattgggctttgggtcacattcatatacgtcagacgctaaatgagcagccgtttattggttattctggtgttttacagggcttaaatcgtaaagaaaccggggacaaaggttattacttggttcactctgagaatcaacgtttaattccagaatttaaaaatattgcaccaattaattggaatagtacgacgatttcgtcaatgacagatgagactgacctaattgatcaaattatcagtctcaaaaatgacaaaataactttttggtcaatcactataactgctcagattgatgcaaccattattgaaagaattaatagcggtgtgacattagacaaactacgtgatcaattaccaactaacatgtgggtcgttcgtttaagtgttgctaatgctagacaattatcattagtttctgacaatattgatcaacaatactggacgggggcgcttgacaaggtgtttgaagagtctaacataactgattacttgccaagtcaagttcctgtatttattcgtgagcatttcatgagtgatgatggtcaggaagaacttcaaaatgctatggaacaattaatcgcagaaaggcgacaaaacaatgaagattaaacgcttagaaattagcggatttggccgttggtcgcaagaagcttttgatttatcggatggtttgcaggttattttcggacaaaatgagtcgggaaaaacaaccctaagagcatttattgtaggtgtcttgtttggctttccaacgaaaaaaaatggtcataatgtttacgatccaaaggacggaagccaatacggtggtagcctaattttagaaaccgatgagggtgatgtcaaaattacgcgtttgaatcgtaccaaaacaactttgacaattacacgcttaattaatcaaacggaaattattgatccagaaaagtggttgaaacaaaaattatcaccacttacaagagaagcatttgacgatatttttaattttaaccaagaagacctaacccgaatatctcaaatcaaatcagtggattttcaaaagttgctactaaatattggtgctgtagggagcaccggttggttagatgtcatggctgaatttgataagtctgctgataaactatttgctccgcgggcaaataaaaggcctttaaatattgccattaaagaatatgaaaatgccacggaagaattacatcaaaaaagtgctgaattagatgactttatgttggcagaacaagcactaactgatttagaaagtgagcaacatgagcaagaagaaaaaattcttactgctagtcaacaactacaagaaacacaacagttagtacaacaataccaattgtttgaatcagctaaaaaaatagaaatcgaaaatgtaccctctgttgatgaaaagcaggtcgtgcaagcacgacgattacaaattgaaattgactctttgaatgataatattttgcggcataatgaagcgttaaaaaatattgaagtgcctcatgaagtgagtgatgacaacaccgaccaaatggttttgacaaaagcacaagtagcgcaacgaaatttggcagtgaatactgagaagcgaactaatttgctaaagcagaaggaacaaattgaagctcagtttgagggggatgtgccgaaaggattaacagacagtgaattgcaaagtttatcctcttcaaatgtgtatttgctgtcaactggtgcgttaattttaatcttattcgttagtatttttataatgcactggcctgccctgtggatgattattttgtcactaattgtaaccgcaggtctcttctataagcgacagaagaaaaatcaaatacgccaaatgattcaaaaggcttacagcccccttaatatacaaaacattaagaagatacagcctgaggtggatcaatatgaacaacaaaaaatggatattcaaagcttaaatgaacaaattgaaggccaatatgacagtcttattcaaatgatacagccaattgcattgaagcttgatattcagattctttcagattcgttagaattaaccattgcgcaattaataagtgttcaacaacaagaaagtctttcagagcaaagtaagcgaagtatgtatgtgcaacagcaaaatcaaattgtcactgaaatacaacaacaacaggaaaagttgtctgagaagttgaacgaacagaaaacaatttttaaagaatatcatgtcacagatttgcacgaactgcaaaacacattagatcaatataataaaaatgaacaattaaagcagcgctatcaagatatcatgaaccaaattgatgaaagtacgcgccaagaactgttaaagtatgataatgaaactcaactgcttgaacagaaggaaaaacaacaaaaatacttaacgatactacaaaaacatgcctttgaattgcagagcgacattgcacattataaagcgcagcaagagcaaagaactagtaacgatcagttcatgatgttacaacaagatcttgctaaccaaaaaacagaactgacacaacaatttggcgaatatttagcaaaaaaaatgagcgtaaaatggataaatcaagccttgcaagatgcatctcaaaatcgctttccaaagatgcagcagttagcaacggactattttcaaaaactgacagccggtcgatatgtaaacattcaattcgataaaaatacgttgcaggtcgtgagaaatgatcgacaaaagtttagtgtagtagaattatctaccgggacgcaagaacaactatatgtggcttttcgtttagcattaagccaagttattaaggatattattaatatgcctattctaatagatgatggctttgttaattttgatttaagtcgcaaacaaaatgttatagcattattaactgatattggacggaatcagcaagttatctattggacagctgctattcataacgaacacttcgacaaagtgatagaattataactaattaagctggtaaggggccatgagatgaacaaattattagcagagtatcaagatacagagcatattgataattttgcattaatcaaagctgcagaggtacgtttaacgaaaacagggaaaacttatatcagtatactgttttcggatcgctcaggagatctgcctggtaatctttgggatgctactgatgaacaaattaagactttgattcctgggaaagttgttagcttacaaggcgttaggggatcatatcgtgatcagcctcagatacaaattactcacgtcagactaactgaagctggggaacctgatagtccttcagattttatgactcatgcgccagttaaagaagccgaaatgagcgaagaacttagtgattttatcttgtcaattgctaatcctacctggaatcgattagttagaaagttatttacgcaatataatgatttgtttttaaaatatcctgccgcaaagatgaatcatcacgcatttggaggcggactggcttttcactctttgtcgattgctaaactagcaaaaaatcttgttttacaatatccgcaacttaatcaggatttgctgatttctggtgccttgctgcatgacttggggaaagtgatcgaactttctggaccaattgctacacaatatacattggcaggaaacttaattggccatattacgttaattgatgagcaaatcgttttggcagcaaatgagttacattttgatttgcagagtgaagaaatgattattttacgtcatgtggttctagcacatcatggtttgctagagtttggatcgcccgttcgtccggcactaatggaagcagaagttctccatcaacttgatgagctggatgcggggattcaaatgatgacgggggctttagaaaaaacaaattcaggatcattttccgataaagtatttggcttagacaatcggaagttttacaaaacagaagaggatttttaactgaaaaattagtagcgtaccccactataaacgtttgaataagaaaaaagcaaaggcacaaaatccaatttggataatcaacactgtgctgacaaatgcaagtaagtgaacatcattcagacgaaatgacacataaattagtaataataaaactgaaaaaatgatgatataaaaccctggcataaatttctccttatttattgtgatcctattttaaattattataagatgcaatagttatatgaattttaaatgatcataagacgtctatcacttgagttttaattgtctatttagtaatgaatttaagttaaagtatagtactcaaatactaatgttatatttttgaacgtctctcatatcagtgctacaataaatgaaatataaatatttgtaatttgacgagaaggaagaaactcatgactattaaaaacccgttagtaattgtatcttttgatgctatgggtgctgaagatattgcagagcacattgatttgatgcctaatgttgctgctttaatcgctcggggaacccatgtaaaaaaagttgaaggcatttatccaacgctaacttatccttcacatacaactattatgactggtgtttatcccgccaagcatggtattgtaaacaatacaaaaatccagccggagttaggggattcaccagactggttttggtacgcgcgggacatcaagacaccaactttatttgatttggcacacaacaagggattaaaaacagccgcttttttatggccggtttcagccaaagcgccaattacatggaatatcgctgaaatttttcctaaccgaatttggaccaaccaatattttgtgtcgtttcatgctagttcaccctattttttatttgatatgaatagaaaatttggtaagtttcgaaaaggaattgcacaaccacagttagaccaatttattacaaaagccgcagcagacacaattaaacacaagaagccagatatgacagctattcatctagttgatatggactcgcatcggcacaaatatggggtgcgttctaagcaagcttatgaggctttaaaaagattagatggcaaccttggtgatattattcaagcgacgaaagatgcaggtgcttttgagcaaaccaatttcgttgttttaggtgatcattttcaaattgacgttgcaaatatgatccatttaaacaagttatttgccattaatgattggctcactgtaactgacaaagggctgattgcaaatgattggcgagtgttagccaaaacaactgatgggtctacgtatatttatataaaagatctttcattagtggatgaggtgcgtgctattgtacagcaagtacctggtatcgaaatgatttatacttctgcagatattatcaagtggcacattgatccagaagccacttttattgttgaagcgcaaaacggttttttctttacagatgaagttgatcggccagtagttgtggaacccacagatgagaaggaattaggtcaaagcgatcgctataaagcagtacatggattcagaccggataaagtaggctatcagactacccttgtgatggccggaccagatattgcgcatggcacaattgaagaagcgagcttagtagatgaagcgcccactatggcacaattacttgatgtgaaattcgaaaatgtcttagacggtataccgctcaccaaagcgtttaaatgaaaatatcttttttggagattgattgtggataaaaaaatggataaaagcgagttaaaagttacaacgcgctacaagacagtgttaaaaagtctggacaacacatggcgtattcttgatgaaggtagggtagctgtactaaaagaggtgttgatgtggttagggcatcctgacaaatcgttaaaaattatccatattgctgggactaatggtaaagggtcaacaggcacaatgttgggatcaattttaaaggccaatggatacacctatggtcatttttcaagtccttctatcatggacgatcgtgaacaaattcgtattaatggggaaatgatatccaaaagtgattttttaaaatattatgatcaattagtcgttctttttaaacatcacaatgtgccactttattatttatcttattttgagtattttacgattatttcattgctggcatttgttgacaaaaaagtgaatttggttatttttgaaacggggttaggtggcctttgggatgccactaatgcgattgagccaccaatgttaactgtttttactaaaattagcattgaccatcaaaatttgttgggacataatatcgccgaaattgctgaaaacaaggctgctattatcaaaccgggtacatgggtaatcgactatccgggacaagatattgaagccaaaaaggtattaaaagcgcgaacagaaaaagttggcgcacgttggttcgaacataagcgagatgaaatcattatagctaatacctcaccatctggtcttgatttgattattaatggcaagagcggttatttcttaagtatggcgggtgcttttcaggttcataatttcagtatcgtattgaaaacgaaagcggcattgatcgaaaaaggatatcaatttgataccgaaaagactcgcaatggcattgctaatgtaaaaatgttgggacggatgaattatcatgctgataaaaacattttgtttgatgctgctcataatgttgatggcattcagggattagtctctgcattaaattcttggcatttaaaaattaagccgactttgattctaggtgttctcaaggacaaagattatcatgagatgttggatgaaattataccatttgttcagcgcgtcattaccgttacaccgaataacaaaacacgagcgttatctgcagacgaattggcaactgatatcttatcgaactatccaagtattgaggttgagattgctaatgatgcttcggcagccatctcacttgcaatgcgtgttcgtgagtcttctcaggcattgattgtcgttactggatcattctacactttaagtgcgattcatagggagggacgtatttagagccatttcaaaaatgatgatgcttagtagcagatcaaattgatcatttattcacttttttaggttgtcaatattttgtgaaaatgtctttctcatgttaaaatgggagagatatttttatgagtatgaaactttatgaggcaaaataatgtcagaattaaaaccaaattttttctgggacgaagtcattgaaaaagtacaaaataatcacgagagcaaacaacctttttttagtatggcaccaatggaagccgtaactgatactgtttttagacgtgttgtcgccaaagcagcggcaccggatgtttattatactgagtttaccaatgctagttcgatggttcatcctaaagctaagttttctgttcagggtcgcttagcagtcgctgaaggcgaacaacagcccgtggcacagatatggggatcaagacccaaagaaatagctgggtcaatagaggttttagcagacatgggctatcaggctgttgatattaatatgggttgcccagatggcacagtgattaaaaatagttctggatctgatttgatcaggcatcctgatttagctgaagaaattattgttgccgctcaaagcggtagtttgccggtttcagtaaaaacgcggcttggtttttataaaccagaagaatttagagagtggttaccaattattttacggcatcaggtagcagttctgactgtccatctacggtctcgtaaagagatgtctaaagcaccagctcattatgaacatattgatgaaatactggcaatgcgtgacgaaatagcacccaacacgttaatccaaattaatggtgatattaaaactagagcacagggaatagcattagtccaagaacacccaggtattgatgggattatgattggtcgaggaatttttgaaaatccgtatgcttttgaaaaggaaccgcgccaacatacactagaagaatcaattgcgttgttgaatctacaattagacttatttgatgaagttagtgaaacggtaacaacgaaacactttgaggctttgaaaagatactttaaaatttatttgcgtggattcgcccatgcttcagcattacgtcaaatgttgatggatacacatacaacgactgaggttcgagaaattttaacccgggaattagccaaggtctatgctgcagtggctgacgataagcatatctaccgtgacaatgctgctgccagtgctgatatggccttgtcagtgaataagcaaaaataagaaggcatttgaaagtttgtgcgactattgcacagcttttttagtataatgaaattatgagattaacaactgaaacaattcaaaatttattagtggaccataatctattattagatgcaccagacgttgatatgacgtttgatttcttacactatgatacccgagaagtacaaaaaaatactttatttgttattaagggcgccttcaaaagagcttacttggataatgtacatggtattacaggattaattacagaaacaaaaattgatgttgatttaccgcagtggcaagtaacgaatgttcaaaaggctttatccttgttatcaatggctttttttgactatccgcaggagcggctctggattggtgcttttacaggtaccaaaggtaaaacgactgctgcttattttgcctatacaatgctgaaagaggcaactaataatcatacagccttattttctacagttgatcgtattactggtccgcaagcatccgacaagaaaaagtctgatttaacaacacctgagtcatatgaattgtttaaagatatgcgtcaagttgttgataatggtatgactcaccttgtgatggaggtgagttcacaagcatatcttaaaaatcgtgtttatggactacgctatgatgtgggcgccttcttgaatatctccccagatcatattggccctaatgagcacccaacatttgaagattatttggcacacaagttgatgttactagatcactcagatgaggtgattgtcaacgctgaaacagaccattttgatactatttacacctatgctaaaaaaacacatcataaggtctacacatacagccgtcaaatgtttacttctgaagaaagtgccattcatgaaagtaggttcactgttgttaagagtgaattcaacgaaatgcttggttcgtatcgtttaaatgttccaggagacttcaatgagtcaaacgcaatggcagcaatgatgttggtttcttttgctggtgttaagcatcaagccatggtaaaaggattagatgaagtgtttattcccggccggatgcttagtttgccaattaatggacatggggttgcttttgttgattatgctcataattttgtctccatgcaggccttacttagctttgcgcaggcccagtatccaaatggtagagtgcttgttgtagttggctccccaggtaataaaggtgtttcgagacgtgctgattttggacacgtagtgagcgatttggctgatgtagtttatttaaccgctgatgatccacaatttgaaaacccattggatattgcacatgagattgctgcgcatatcaataatgataaattagaggtgcattatgaaatgaatcgtattgcagccattcatgaagcaatttctgctgcaaatgaaaatgatattgttattgttgctggcaagggtgaagatccttatcaaaaaatagatggtgttgatgtgccttacattggcgattacgccgttgtaaaacaatttagagatcagataaagaacccgtaagggttcttttttgcgctgtaaactttaaaatgtatcatttttttggtcaaactagtggtacaatgaagttgtagagtgtaagcggttacaataaggagctgataatatgcaatttattaattactttaatcaagatgcctataccaacatcgccatggatgcttggttactgaaaaatttaaaaccaaaaaagccggtttttgcattatggcagaacaaaaaagcagtgattattggtgaaaatcaaaacactttttcggaggtaaatcaggcgtatatagagtcacaaaatgttcaagttgttcgtcgtgtttcaggagggggcgcagtttatcatgatttaggaaacatttgttttacattttttgttccagttgctactagtgctagtgttgattttcatcaatttgttaaaccaatggcggatgctttggagtcacttggtatacatgttgatatctccggacgaaatgatttagagattgcggggaaaaaggtttctgggaatgcccagagatatgccggtggctatctaatgcatcatggcacactgctctgggacactgatgtggatgctatggtacgttctcttaatgtggctgacgaaaagttcatatctaaggcggctaaatcagttcgtgctcgtgttggcaatatcaaagactatgcacctgaagggttaacaattagtacatttattgatcagttgaaatactatttaacagatgagggcaaagatacggaatatgtgttgagtgaagcacaaaaggcttctatcaaaaagctgcgcgatgaaaagttttcacagtgggcctggaattacggaaaaagcccacagtttatgtataacaatcatgctaaatatgatggtggtgcaattgatgtacaaatcgatgttaaaaatggtgatattacagatgtaaactttacaggagactttttaggggttagagattggcgtgaaataaaatcagaattaatcggtattccatttactcgcgatgcaattgccgaagtacttgacagaaataaagatggtcaatactttggcagcatcacaaatgatgagcttttagaaacattctttcagaaagatgaggtaaaaataaatggctgacataacagcaacaaataagcaagtacttgactttaatcatcagcttactgcacaagcagatagtttcccaacattaagtgtattagacaatactggaaaaattgttgatgatgaagctttcgagcgtgctgagttatctaatgaagacttaatcaatattataaaacgcatgattttaagtcggcagttagatattcgttcaacaaaactagctaagcaggggcggtttggattttttgcaccaacagctggtcaagaagcctcacagatggcctcctcttatgcttttaatgatgatgactggctaatgccgggttatcgtgacatcccccaaattgttgtgaagggatggccaatttggaaagcgattttgtggtcacgtgggcatgttttaggtaatgtatatactactgaagacgacaaaccagtaaattcgtggatgccacaaattatcattggtgctcagtatgtggaggcggccggcattgcgttagggttgaagaaacgtggaaaaaacgcggtcgtgtatgcttatacaggtgatggtggtacatcacaaggcgatttttatgagggcataaatttcgccggagcgtataacgctaatgcagtgttcttcgttcagaacaatggttacgctatttctacaccacgcgctttgcaaacagcagcaccgcatttagctgcaaaaggttgggcggctggattaccaagcctggtagtggacgggaacgatccaatcgctgtttatttggcttctaaagaggctcgtgcatgggcggcaaacggcaatggccctgtgctgattgaaacgattactaatcgtttggaggctcattcgacagctggagatgatccgctacgttaccgaacgaaagatgatattggagaatggtggaaaaaagaaccgcttattcgcatgcgcaagttattgcaggatcagggtatttggaacgaagaacaagaagacgattatgtaaaagaagtcaatcaactgattgatgatcaaattaagattgcagatagtgtcgagaaacaaaaaatttctaactttattaaaaatacactcgaagtcccaagtcaagcaatgaaagagcaaatagctaagtttgaaagcgagggaaagtaacatggctgtgaaaagttatatcgatgccatccgtgaagcgatggacttggcattggaaaaagatgatgatgtgattatctttggtgaagacgttggaaaaaatggtggtgttttccgtgccactgatggtcttcaagctaaatacggcgaagatcgtgtgtttaatacgcctttagcagaatcaggtataggtggcatggcaattggtttgactactcaagattatcgaccaattatggaaattcaattctttggctttgtgtttgaagtaatggattcgatagcaggtcaaatggcacgaaatcgtttccggtttaatggtacgcgtaacatgccaattgttgtccgttcgccttatggtggcggaactaaaacaccagaaatgcatgctgataatttagagggcatggtagcacaaattcctggtatccgagttgtgatgccggcaaatcctgctgacgcaaaggggctgctactaagttctattgcgtccaatgatccagttgtatttctagaaaatttacatttgtatagatcattgaaaggtgaagtgccggaaggatactacacgacaccattagataaagctgcgattgcacgcgagggagatgatgtatcaatcatttcgtatggcggtggtgttcctgttgccttgaaggcagctgaggaattatctaagaacggtatttcagctgaggtgctagatcttcgtacagtttcaccattagatattcaatcaatcggagaaaccgttgctaaaacaggtcgtgtggttgttgtgcaagaagcgcagcgaatggcaggtattggcgctgctattatgagtgaaatttctgaacgatttattttgagtttaaaagcacctatcggtcgagtagctgcaccagactctgtttatccatttggacaagcagaaaacgattggatgattaagtctgacgatgttgtggccaaagtagtggaggttgtaaattatgactgagatttttaagatgccagatattggcgaaggtatggcggagggagatattacttcttggttggttaaagttggtgatacgatagcggctgatgatccagtcgcagaagtacaaaatgataaattgatgcaagaaattttgtctccgtatggtggtaaagttacaaaactttttgttgatgccggaacaacagttgaggttggcgatccattaattgagtttgatggagacggcagcagtgaaaatgactctgataacggtcatgtagcgcaaccaagtatttcttcgaacgtagtggagacagagcaaagcaccccaaaaaacacagctcctaaggaaactagcactgttcaagtagtaaacggtcatgtgctggcaatgccatcagtacgtcatttggctcatgagaaaaatatagatttaacacaagtaccagctactggtcgccatggtcatgttacattagcagacgttgaaaatttccagggatcagacaattcagcacccactcaaacgcaaacatcaaccacatctcaaacagagtcgtctgcagctgttcatgaggaaccagcattaccattgcgtgaagggcgtcaaccaatggcaccagtacgtaaagcgatagctagagcgatggataggcaagcagctattccaacagtaacgaattttgattctgttgatgttagaaaattggttggccaccgtaaggcgtttaaggaaatggctcgagatgacaaaggcatacgtttaacatacctagcctatgctgttaaagcgttggcagctgtagctaagaaattcccagaattaaatgctagtgttgacatgaaggcgcaagaaattgtttatcacgatgatgttaacatgggtatcgctgtggatgcgccagctgggttgtttgtaccagtcattaagaatgcagatcgaaagtctattttcacaattgcgcaagaaataactgatcttgctgaagcagttcgtgatggatcaattacacctgcccaaatgcagggcggaacaatcacaatttctaaccttggttcggcccgaggtacttggtttacaccaattattaacggtaaagaagtagcaatattgggattaggttcgatcttaaaggaaccgattgtcaatgacgatggagagctagccgtgggccaaaacatgaaattatcattgacctatgatcatcgtttgattgatggcatgctaggacaatcggcccttaattatttgaagcagctattgtctgacccagcctatatgttgatggaggtgtaattatggttgttggtgcacaagcacgtgaaattgatacagtagtcattggatctggtcctggtggttatgttgctgctattcgggctgctgaacttggacaaaaagttgttattatcgagcgtgataatattggtggtgtgtgcttaaatattggttgtattccatcaaaggcattaattaatgtgggtcatagataccgtgaagcaactgaggagactccgtttggattactcacttctggagccacacttgactggcaacagacacaagattggaaacaaaataaggtggtacacacgctaacttctggtgtagagatgctattaaaaaagcatcatgttgaaattgttaaaggagaggcagtgttcaatgacaacgagaccttgaatgttttacaagaggatggtcatgaactattgcagtttaacaatgcaataattgctacaggttcgaggccaattgaaattccaactattccgtttggtgaacgcatcgttgattctactggtgctttaggttttactgaaataccaaaaagattaattattgttggtggtggcgttattggatctgagattggcggtgcctatgctaatttaggagcgcaagtaaccattattgagggtttggatcacacactgaacggttttgatgcggaaatgacgaaaccagtattagatgattttaaagctcatggtggtacggttgtgacatccgcaatggctaaggaagcaacacagactgctaaggaagtgacgttgacctacgaggcagacggtaaggagcaaagtattacgggcgattatctcttagtagctgtgggacgtcgtgccaatacagacggtttgggattgaacaataccgatatcaaagtagacagcaaaggcttgattacaacaagcgatacaatgaaaacgagtgtaccgcatatatatgccattggagacgttgtcgcaggtccgcagttggctcataaagctagttttgaaggaaaaatagctgctgcagccatcgcagaagatgcgcaggcgcgtgatttacattattcactaccttctgtagcctatacgcagtatgaattagcaacaactggtgaaacgcctgagtcagtcaaagtaaatcatttggatgcaaaaatttcaaagttcccgtttgccggtaatggtcgagccatttctatggatcaagctgttggttttgtacggctgattagtgataagagtagtaatgccttaattggcgcacagattgttggtccctctgcatcagacctgatttccgagctgtccttagcgattgaaaatggtttgacaacgaaggatatttcattgacaatacatccacatccgacactcggtgaagcaattatggatgcagctgagttagccgatgggctaccaatccatatttaagtacaaagttgtgatgagtttaagaattgaagatgttgggggtaaacaatgtcaacatttataacaaatgatgacgtaaaactgaattacaatatatacggcgacgggcaaccaattattttagttgcaggttattcaggcaatcaggctacgtgggcggcacaaatagaaccgcttaaacaggctgggtttcaggtgattacttatgatcgtcgcaatcatggtgaaagtcaaacggttgattatggcatgcgtatgtcaagacatgggcaagatttagccgagttgatcgcagcgcttcatctcaatcaagtaattcttgtaggacattcaatgggtgcaagtacaatttggtcctatttgtcgctgtatggcgaagcagatgtcaaagctattattacggaagatcaaattcccaagattttaagggatgaaacttggtctctggggatttttaatgcagatataacaatgatatggacggcggcagaaaagttgccatatactaaattaacacatgctaaaatttcaagtgacatcaaacgtaaacttgcagcggcttatcatccctttaactttaaatataatgaaccgttattagtaaacagttttatcgaagattggcgtgacattgttaaacgtgaacgcgtaccacatttattcttggcgggtaaacattctccgttatggccagctgaccacgtttatgatttgaaggctatgtctacattcggtgaagaacacatatttgaagaagcgggacatattccacatattgaagaaccagaaaatttcaatcaagtgaccatcaactttttaaaacgcatcgatgattattagactgataataacagattatgacattaatttgttttaatggtaacatgagattgttcgggttacgtactataaatagtactagcttgtgctttcttttttatgtctaaaataaaatttataatatccctgaagttcgtgagagaatacttatgaacaaaataaaattaaatacactttttaaatgggcagtcgccttgtttatttacaatctcgttgccaaaataatcatttattttgctcaaaaaacgttaccggacttttatcgagttgatacgagtagtttagcttcactgaccgactcaacttcaaaatacttaggatctttattgggaataattgcggtttatattgtcctttggtttatgttcgcaggtattgtattatactttcttcggcgttcgtggggagaaaaaagcgaaaagcgttttactaggcagttgttgtcttacaaattacatacttcaatcgcggcatttattattttgatggtcccgttagttgaatttggtttaaaagtgccatttgctcaatatcttgcattacccaaaacttttgttgatatggtgagtggattttgggcaaatacaattttcacagcgtgttatcttgtactgattttattgttaattaaattcagacacattagttattttgcgatttatcaagattattccttattgaatgctatcaagatatctgtaagagaaggcatggcctcggcaatacagttattcttaaaatcaataattcgtttggtggtagcaagtggcattggttttgcgttattatattttttgcagctatttgctgatactttttttgacgtaaataatagacgcctcattgctaatatcttacttgccattacaagtggattaatgtatgttattactgcatatatcttaaacctgtatgtcactcttttgacaaccgaccacaagaaagatgctgaaaaaaaattgaatggctcttcgatatttttgcaaggactcatactcatagtcattggggcaggcagtactttaatttccggtaattattttatatcgccaagagaaaaatatttagtgattgcacataaaggtgtttcatatcctaatgccgtcccaaactcgttaattgctttgaaaagaactattgctactcatcctgattacattgaaattgacattcaacccacaaaagatggcgtatatgttctgacacacaatactaaagtaaaaacagtctcgggggaaacgcttgacatatcaaaaacaaattggtcgactctgaaaaccaaaaaagttacagaagatgggcatcaattttatttaactagcttttcgaaatatattgatttggcgaataacaaaaaacaaaaattattagtagaattgaagttgaatcaaacgataacagatgagcaattaaaacaatttgtagccaaatatggcaagcaaatgaaggaaaataaaagcgaaattcaatcaatgaaccaaaacgttattaagcgaatatatcaatacactagtttaactacaggattattatcaccccttaaaaatacagttgatggaaataaaattagtaaattctatgctatagaatattcaaaggttgatgcacatttatccagccaaattagacagcataacaaagatttgtatagttggacagttaacgacaagcttgatgttgaaacggcctatatgataggtgtcaatggcgtgattaccgataagccacgagagacacggacgattttagaaaatatcagtgaaaagttgacttatcgtagagcatttatttctatgattttgaatcagcaaagtgatatttaattcaatctttttgagttcgtgcaaaataattatgtatgcccgtgagggcttttttgttaacgtaatgatttacgatatcctgccgcttgggcgtctgcttcactattaaaataaacagcgttgctactgttcatatagtagccagcttgaccaggaacatgataaatatgtgattttgaatttccgataatttgttgactttcaccagtgtatgtttgtgttgctgcagattgattctgtgctgcttgtgcttgtgcagctgaagctgctgctgcagaattagctgccgcttgagatgacgcggcggctgcctgtgatacactagcttcacttgcagctttttgtgcagcagctattgaagattgttctgcttcggaactagctttggcagatgacactgcttcagaactggctctggcagatgaagaagctgccgcggagctagcttcttctgcagcttctttttgagcggctaagtcagcttttttgtgtaatgtatttttggccgttccatcagcataattaataattgcgtttgaactgtcattatttaggtaaactactgttgcaccgtcattgccatcttcttcacggtatgatttaagactaatcttaactttctctccagagttagaatatcctatgtaagataggcgaatctgtcgtggcaagagttcattgccactatacattggtgtaacttgataatctaaacggcttgatttgtggtgcttaagccattttgtgagacctctttcataataaagcatagcttttttgttactggcattcgattttttaagtgcgccagtatttaggtaagctgtctctggaactaagttttttgcttcatcatttaaaccgctgaattgatagccaataagatgtccgcgattgaatagccatgacttaccaatagatgcgttggcttttttatatttgaatttataattgtgccaaccaacaggattgtagtttagttttgtcgcttgttttgcagttggttcttcagcataattgagctgaatatgagcatcaaccgcacgcttttgactatcttgatcagctagaacaagttgtttttcgtttttgaaactaagaggatgctgctcagcaccacttagtttgtccttttgataactatcagcagcaacacccaaagcagggtatatcgtactagtggcaaccactaacactgcactgatagttactttttttagtaactttaacataataaattctctcccgaacagtttagcgtggatatttggcacgtattgaacaatcattttttagtattattaaaaaataggaacaaattttttacttttaagcgtgagttaccatacttttttaattataatacttctaaagtatgatatgcaaatatacttgtacagaccagttgttcgatatgtaaacttaaaacatttatatcataaaaggcattgacggaacttgaaatgctgatataataaatttgtaagcgttttcttatgttgaggattcgtttacacatcaataattttctgacaacgagtcagatgctccttaaatatgtatgctgaaatgtgtacaataaataagatgtggtcacggaaaaccatatcttattttttcaatatttatgtttttcaagtttaatttattatgttttgatgatataatttaaactggttgtgacctacgatagtttcgaaaatatcatgatgtaaaattaccaattttatttcaaagtactattgtggggcattactgtctggaccattagctcagttggttagagcaaacggctcataaccgttcggtcgttggttcgagtccaacatggtccatctatttactttaattttagtaggagcttgtcttctaattgtctttctgatatcgattttttaataggcaccaatcaataaaaacgaaataggctaagaacaaccaaacggagtattttggttgtttttatttgctactattttaagtgaaaggaggatatgctaatgagtcgagatattgattacgatgtactgagaaaaaatcagcaagaaaaccgtgccaatgcttatttgaataaaggcttgcgattatttggtgctgcgcctatggtaactatgggggtagccactaaaggttatatgaccgagagtggtttttattcagacaagcattgataatagggaaaaaaagtcagccaggttggtttctggttggtttttattttcacaaaaagtagatgatgaattaagtctaaagcatattaaacatcaagattaatccaaaaatgagaactagccattaaaagcgtataatatgaagtaaatgagaaggaggatggatgatgtcagacatatttttaaaaaaactacgcaatattattgggtttgacgctattgtgtcaattatttttggtgctctgatacttttttggccaacgcacagtgcttcagtagtagccgctttgattgggttagcttttattgcgataggtatatcgcacatagcatccgtattcgatagaaaagatgaagacggttgggctcgtgtgggtaacttggttattggggctgtctactttatcgctggcgtattcacctttataaacttgtatgcagcaactacctacttgtttataattgtcggcttgcttgttggtatgacatggatactggaaggaattattgaatttgggtcactgaagtattacacacaaaaagggtgggcgatgttttcagctctcatcagtattattggtggaatcgcgttattgtttgcgcctttgctcagtgcaatcttcctttggcaattacttggggcctctttactggtactaggtattattaaactgttgcatttctttgcttggaaaaggtaaaacttattttccaattacaacgccgtctgcttagattaattctggacagacggttttgtgttataatcaaatcaattttaaattataaagtcttaaacaatttgattagtgactgatgtaacagaaaatactatatttaaacataaaagattgcgaggaaatttactttggcagaaaccaaaacagcaacaaaaaagaaaaaagcagcaccacggaagaaatctaaaatcaagaaaaatctagttattgttgaaagtccatcgaaagcaaaaacaattgaaaagtatttaggtcgcaactataaagtagttgctagccttggtcatatacgtgatctgcctaaatccaccttaggtgttgatgtcgaaaacgattataatcctaagtatattaatattcgtggaaaaggcgatgttattaagggattacgcaaggaagcaaaagccgcaaaagccgtttatctggcttccgatccggatcgtgaaggtgaagcaatagcttggcatttgcagcatattttggatttaaatcctgaacaacctaatcgagttgttttcaatgaaatcacaaaagatacgattaaaaattcctttaaaacaccgcgtgttattaatcaagatcttgttgatgcacagcaagcacgtcgtattcttgatcgattagtaggttattcaatatcaccgattctttggaaaaccgtgaagcgtgggttgtcggctggccgtgtgcagtctgtggccttaggcttgatcattgcgcgtgaacgtgagatacaggcttttcagccagaagaatattggacgctagattctatgtttaaaaagaatcgcaccaaattcaaatcaatattctacggatttgatggaaaaaagcagccattgccagacaatgacagtgtgcaagatgtgttgaagcggattaacaaagatggtgattttgatattgttaaggtggatacgaagcaacgcaagcgccaacctcaaccaccatttacgacgtcaacaatgcaacaaacagccaatacacagttaaaatttagaacgcgtaaaacaatgatggctgcacagcaactatatgaaggtattaatctgggtaaggggttaggtcaagtaggattaattacttatatgcgtacagattcgacgcgtatttcatctgttgcaaagaatgctgcagcacaatttattcacgatacatggggtgaagaatactcacagcataagccagtgcaaggaaagctacaggagggagctcaagatgcgcatgaggccatacgaccatctgatgtcaatcggacgccagagtctatcaaagataaactaacccctgatcaatttaagctatactctttgatctggtcccgatttgttgctagccaaatgacaccagaaattttagatacaatggctgtgacaattgaacaaaacggcgttatctttagagctaacggttctaaaacaaattttgaaggatttacaaaggcctatccaacagcaaaaaagaaagataatgttttgccttcgttgagcgaaggggacaaggtgagtttggcaaatacagatcctgaacaacacttcactttgccaccagcacgctattctgaagcaacgctaattaaagccttagaggaaaatggcgtagggcgtccatcaacttacgcaccaactctagatacaattcaacggcggaactatgttcgtattgatgctcgtaagtttgtgccaactgaactgggagaaattgttcaaacgattgtcgaagaaagttttcctgacgtgacaaacatgaagttcacggctgcggttgaacatgagctagatgaggtcgaaacgggtaacaagcactgggtaccagtcattgattcattctttaaaccctttcaaaaggaagtcgagaaagctgagacatctcttgaaaagattattatgcatgatgaactggcggggatggattgcgaggtttgtggtgcgcccatgctagtcaaaatgggtcgttatggcaagttctatgcctgtgcacgtttccccgattgtcgtaatacaaaagcaattgttcaggaaatcggtttgctatgtccaaagtgccataaaggacaaattgttcagcgaaaaactaaacgtggacgaacgttttatggttgccaaagatatcccgattgtgactttgtaacttgggataaacctacggaaaagacattagctgacggtacaacaccaaaagatgatgagaaaaaagaaccagtcaaaaaataaaagccacaattttatattgtggcttttattttaatttgaatattgattttttgggacgaagataagaaaaaccttcgccaagctgttcttgcgttgtaaatatggaaacaaaagcttttggatcaacctgatcaacaatgcgccggactgtgctgacttctgaagggtcaactacggcataaacaacacgttgatctcgatgagagtagcctccttcagctttaagcaaactagtaccacgatcaagttcatccataatagcatgtgacatttcttctggatactgtgtaaagatcataaaggaccttgcatcataagcgccgcgttgcgtcatgctaacaacttgtgaaaatacaaatgaagcaatcagtgtgtacatcatgtgaacaatatcaatataaacaagtgataacagtaaaacacaggcatctaggataaacattgtccgtccgataggaatgctaaatttttgctctacaatacgagcgacaacgtcactgccgcctgatgtgccaccaaagcggaatacaatgcctaaaccaaatccggcaattatcccggcaattattccagcaatcagcatatcatgatgaagtgcaggcggagtgggcacaacttgccacaaccaaagccaaaatgatagggatgcaatgccccaaatagtgtaaatcagtgcacgacgccctaaaatacgatagccaataaaaagtaaagggaaatttaatagtaagttagtataagcaggattccaattaaaaagtgcacgcaaaattagtgtgataccagaaatgccgccttcggctaagtcattaggaatgttaacattaattaacccccagccatacattccagtaccaattgcaatcataattaagtctctaatagaaatacgttctagattagttgtttccatagtcaaaacctcgcaatatctcgtaaaattaatcataccatatatatggtaggaaatttatcgctttatttgatataatagttagtgattagaggttaatatggcagattataataattataaacgaccacaattttataaaaaaaagcatccagtacgtaatttttttatcgtgcttgtaattttaattgttgtagcgttgagtatttttatctacatgaattattcaacagcacaaaaaacaaccacaccaattgaacagaaaactagtacaaacagtacaatcgaagaaaattctgattcaacatctgaagatagcagttcttcggatgaaagtgaatcaagtgattctgagtcatcgtcaagtgaatcaagctcgtcgtcatcttcaagtagctcaagttcatcatcttcaagcagttcaagtagtgccgctgattcagcgcaattaaagggcaaaaagattagtgaagctattgcatgggctaaagaaaataggcgtacttattcatggaacattacatcaggtggaaatgatgccgttgtgacgcagattacagatgatggacagaatattagttttacagcatcagctgatcaataatggttaagaagttactaacaatcgctggctctgattcactttcaggtggtggaattcaggctgatttagctacatttaatgaatttggatactttgggttaagtgtgatcacaagtattgtgaccgtaacaaacgacaattttaaaatttatccaactgatttaaaaattattcaagcacaacttgattcaacgttagcatcagatgatattgctgcgattaaagttggcttactgcccacagttgacattattgatctagttgctgagtatttaaaaaaagtcgatgtacctgttattgttgatcccgtgatggtgttcaaagaaacggatagtacaaatactgattttttggtacaagaaataaaaaatcagttattaccattagccacagtcgcaactccaaatttagatgaggcacaattattgtctggtgtaacgattcagagtgtagacgatatgaaagctgcagcaaaagttattggtagttttggagtcgagagtgttgtagttaaaagtggcgcgcgactcgctggtaatcaaacattcgatcttttgtttcacaataacaactatacaatatttgaacagaaaaaagtgatgtcaaatatccccatgaacaacggcgctggctgtactttttcatccagcattgcagctaacatcgtaacgtccagtgttacggatgctgtagcggatgcaaaagcatttgtacttgcgggcattgaaaatggtgtgataataaatgaaaattttgaagtaggcaatgtctggcaggccgctaggcgtctgcgcaacaactaaagtaaaagcgacagatcaacatctgttgctttttatatgttaaaggcacatgtgaaatggtaatcatagacgaattgatacaatatcgacgcacactgaggtcgatggatcgcagtttattaaatcaaatgttggataatgttcaagttgctgcattctttgaaactagtgataaaaaaagcacaatgtatgcatttggacaaaaaaaaatatggtcaaaaatgccagataaaacagattcgattgtttttggtgccagctcttttgatgatcagttagaagcaggaatcatgaagggtttttggtttgagcctgaatttttagttttattgcaagataatcaattactatctagtactacagctattgacgattatttaatgcaacttagtcaattaaaaaaaccacaagcaccgcaaattatcgatgaaagtgctgagactgattggcaagcaagggtgcagactttaattaatgagttgagtgttaatcgaagtttaaaaaaggtggtttttagtcggcaacagcaaataaccttatcagcaaaattggttttgtctaaagttataccagcactgcaaaaacagcaagatgtttatcatgcggccctcaaaagggatactgaactatttataactgccacaccagagcgactggttaaaataaatgataaccaagtagaaacagcagctgtggccggtacaattcgtcgcggacagatagacctagaagatgttaaactgggtaaagagttattgaatagcgaaaagaacaatcaagagcatcgttatgttgtggataatattgttcagcaattgggtagtttaactaatcaattgcatgtgccaaataagcctttcttgttgaaaaataagcaggttcaacatctttatacgccaatccaaggcacattagctaccaacatttctattaaagatgttgtcggaaaattacatccaaccccagctttgggcggtttaccaagaaaaaatgccttggtatatattcgtaattatgaattgcatccccgaggattatttgcatccccaataggatattttacaaaaaataatttcggagaattcgttgtcgctattagatcaatgtatgttaatgggcgaaatgctcgtctgtttgcaggcgctggtattgttgctgaatcagatagccaacaagaatattacgaaacaactttaaagtttcaaccaatgcttgagttactggaggaactatcaaatgacggacacactaacttttaatacaaagcacctactagaggcactatttgaaagtggcattcgacattttattgtgtctcctggatccagaagtacaccgatagcattacttttagcagaatacgcagaacaaaataatgaaattaaattatttgttgatgttgatgaacggtcagctggcttttttgctttaggaatcgccaaaacacttttagaacctgttgttctgctaggaacatctggcactgcaattgcagagtatatgccagcagtggctgaagcgtatgctgcgaacataccattagtcgtattatcgactgatcgaccccaagaattgcagttcaatggggcgccacagactataccgcaaagcaacttgtttggacaattaacaaagcaagcagttttaatacgtttgcaagatatgcacagcgatgtgacagagtatattgatttcatagtacaaaaagtggttaacttatctattactgcaccacgtggccctattcaaattaatttaccacttcgtaagccattaatgcctatattagctcgccaagatgaggtgcatgttcaacgagtagtttttgacaagcaatccgtgcaatatcgtttaccaccaataacggcaaaaagattattaatattggctggtccaaatgttttgaatagttatgacgatagtttgaaaaagttcgctattaaaaataatgtacctgtcattgccgatgttctgagtcaaagcagacacacatatacaattcatggcatagatgttttacttcaggcacataagattaatgctgatttgaagcctgatttagttgttcggtttggtaaaacgccagtgtctgcacgtgtattacagtggctaaaagaggaaaatattttaacttggcatgttgatgaagatgctggtgtagatcatacaaggcatattgcacgagcaatcaagatggcgccacatgatttcctggaaagcatgcatttgacgctgtctaaaaatcagattgattttaatcaaaagtggttgtctttgcctaaagtaataaaaactcgtaacgaaatgaatattataactgctttggatgatgctgttccagatgacacgcatatttttgtggctaacagtatgccaatacgtgacatggataacttttttactggaaaccatacgcagcgcatttatgcaaaccgtggagctaacggcattgatggtgtgatatcgagtgcattgggcatgagcgcagtggttaagcagcggagtgttttgttgacaggtgatttgacgctgtttcatgatatgaatggtttaatgatggctaaaaactatcagttaccgttagatattatcgtaattaataacaacggtgggggcattttctcatttctaccacaggccggtgcgccaaagtattttgaacaattatttggcacgccgttaaatatagacattaaaaaaatcgctgatttatatgatatagactatcatcaattgaatgttccagaagcattaagccaaattctacagacaccttcaaaaacgacaagactgattgaatataaaagtgatcgtcagaggaatagagatgaccatcgtgaagtattggagatgttaaaatgattattgacgtcaataattatccttatcaggcttacctgacgaaaaataatgatgaaaatcaaaagtggctattattacatggctttatgggctctcattgtgattttaatcatattattgatcatttaccgggacaagtactgactttggacttactggggtttggtggtcatacaacgtcggttgaagttaccagatttgaaatggctcatcaaatacaagatttagcgattatattgaatcaattgcactggaaaaatattaacctactaggctactcgatgggcggtcggttagctttaggctttaccaaggtgcacagtgagttggtaaaacgattatacttagagagcacaactgctggactgaagactgctcaagaacgtcatgaacggcgtgtttctgattacaaaaaggctgaaaaaatccagcaaaactttgaaacatttgttacggactgggagcagatgccactatttgctacacaacaacatgttagtccagagcaaaagaagtttatgcatcaacaacggataaatcagaatccaatcaacgttgcgaactcactccgatatatgggtagtggtgtgcaaccaaattattggccttgtttgcaatcattacatacacccacacaagttattgtaggagaacaagatattaaatttaaccttattgccgaagaaatgacaaacttactgccaaatgccaaaataagcatagtgcccaatgctggacataatgcgcattttgagcaaccagcagcatttattgaggtactcgatgtatcaaattaaaaaaataactttaatacctattgcactgactatgttgcaagcctttgaaactgcgcatcacaccattagcgaacgaccattaactattgtcaccgttgaactattgaacgaagatagtggtgagatagctgtaggttatggtgaagttcagtcgtttgcagacttctcgtatacgcttgaaaatcaatctgtcagtcgagaaattttaaaaacagttttgttaccacaaattcgaagattctcttttagtaatccccaatcgttttcgatacgtttgaatcaactgacgccatttgcttcattcgctaaggcaggtttagaaatggctgtttgggacgcgattggtaaactaacgcatcaatctctacaacaaatgattcatggccaagggggaacagttccagtcggaatcgctgtcggtatggcagatagtattgatgaagcattaacgcaaggatatcagagaattaagcttaaaattgatgctcatgtagttgactttgaaaatttgaaccggctgttaaaaaaatatcctgaacaacaattttcaattgatgcaaacagtagctttacagatgaaaatattgcacaaattaacaggttacctgaaaatgttgggttcattgaacaaccacttggtgaaaatgattttgtacagcatgcggtactccaagctcatacaagtaaaatcattagtttagacgaatcaattaataatcttaacgatgttgctacgatgttgaaatgtcgttcggcgaaagctttgacaattaaacagggcaagattggtggtatttccaacgctttgacggctattcaacttgttgataagccatgggttggcggcatgctaactagtggtttaggtagaagcgtcgatatagcaattagtagtttacctaaaattgctttcccaggagatatttcagatagcaggcgctattttgaacgtgatattattgaggaacgtttacgcgtgaataatgggattatatcagtgccaaggaattacggcattggcgtgacagtagatttaaatgcgatttcagatctgcaaacggaacaaatgtttacaattactgattaaaaacgaggttattatggaaacgaactatgcgcaacaaatgcttgatgctctctcaagtgggcaactagatgatgcaaaaaaattttttgcacaatcattacgaaaagatagtgatgatttaatttatagtttagctgaggagttatatgctcttgggtttttgaaccagtcacgtcgtgcctataaaaaattattagaaaaataccctgatgaggatgaacttcgtacggcattagctgatattgcgatagaagatggtgagattgatgaagcgcaagactatttagcgcaaattaagcctgattcaccttcatacttacaggctttactcgttaaggcagatgtctatcagtctgagggattaacggaatctgcagaacacagtctattgcaggcagaaagaatatccccagatgaagatgtgattcaatttgccttagctgaattttattatgctaatcaaagttatcccaaggcggttccacgctatcgtgcgttgttgaaaaaaggcaaacgagaaattagtcgagttgatattgtagcgcgtattggtatggcgtatgctcaagtgggtaattatgagcatgcggttggttatttagaacaaattaaaccagaacaaatgacattagatacacgattccaattggcagttctgtatcaagaaaacaaacgaacccgagaagcgattgatttgtttaatggtgtattggaagtggaccctaaatatacgtctatttatccgatattgggacaagcgtatgaacaagaacaacaacttgaggacgcttaccgagtttatcaagaaggattagctcaagatgagaccaatacagtattatatcgtctagcagggttggcagcagaaaaacttggagatgatgctaaagctaaagcatattatcaaaatgctttggcgttagatgatacagatgtgacgtcaataattattttgtctgctttgctattaaagcaacgagaattcgaagcagacattcagttgttagagaaacatattcaagaagatgttattgatccggaattttactggcatttggcgcgcgcctattatcaggcaggcaaggaagatcaagctactaaatattgggaaatggctttaccctttttccaagagaatacttcatttttgcgtgatattattgattggtaccatgaagaaggtgaacgtcaaggtgagattgatatgatggtcagatatttaaatatcgaaccagaagatgctgatatgcaaatgcgattagaaaatgcaaaatattaaagatacgcaaatgctgctattttggtaaaatagactcatatgaaaattacacaattacctcaagaatttatagatgcacaaccaatattaacaaagttagaagatgctggatttgaagcttattttgttggtggttcggtacgtgatactatgcttggaaaaacgattcatgatgttgatattgcaagtagcgcttttccagaagaagttaaatcattgttccataatactgtggatacgggcattcaacacgggacagtgatggttttggaccatgggacaggatatgaaattacgacttttcgtgtcgagtcaacttacacagattttaggcgacctgatcatgtcacttttgtacgtagcctcgaagaggatcttaaaagacgtgatttcacaattaatgctttggcaatgcggcacgacggtgaggtattagatctctttgatggtctagaggacatgaaaaaaggcgttattcgagccgttggtgatgccgaaaaacgcttcacagaagatgccctgagaatgatgcgtgccctgagatttagcgcccaacttggttttaacattgaagctgatactcaaaaagcattggtagatttggcaccgaacttggctaaaatcgcggttgaacgagttcgagttgaatttgaaaaattattgttaggtagtcaagcatcgcagagtttagaactggccctgcgcgatcaggtcatgaattatttaccaggtccgcacattgaagattggtcaagtattatagatgatttaaataaagaccaggctacaaattataccgtggcttgggcacatatattatcaagaacgcaatttgatgacaagaaacgtcgtcaatttatgtacgattggaaaatgagtcgtaacgtgatgaaaacggtcaacgcaattgttcctattgtgcataatccaaagaaatcaactgtatttgatatataccaagttttagcttatcaggaagaattgcttgaagttttgtcactaactggtagtcagcccgagacaattcagagaataagtcatataatagagatgttaccgattacaaaagctgctgatcttaacattagtggcggtgaattgatccgttctggtattttaacacctgggcctttattggggcgtgtgcttaaaaaaattgagtacgcagtcgttgttggtgatattttaaatgatcacgacgcacttgaaaagtttgcaaaggagtacgtaaatgaccaaaattaaaatggtatgggctgaagatcgtcaacatgcaattggaaaagatggtggtataccttggcatatgcctgatgatctcaaactgtttagagatgaaacagtcaataccctaatgattatggggcgcccaacgtggcttagcattgggcggccattgcctaaacgaacaactgtagttatgactaggcaagaagactggacaccaagttatccagaagtaaaagttattcattccattgaagaagccaaaaatttgatagctaaggaagagcgagatattacgattgctggtggcgcagcagtttaccgtgaatttatgccctatgcaacagatttagttataacgcgagttgacggtgtgattgatggcgatacttttgttgatgaggtgaatttaacacaatttcaactaaagtccagtgaaccacatgctaaagatgataatcatgattacgcattcgttgtcgaacgctacgaacgcatataaggaaaaaatatgtcaaatattaaaatcgttacagattcagctgtagcattaactccagaagaaattaccaaatacgatatcaaaattgtgccgctatcagtacaaatcgatggtacagtctatgaagatggtgtcactattcagcgcgatgaatttcttgaaaagatgattgaaagtaagagccttcctcaaacatcgcagccatcaatcggcacatttcaagctgtttatgatgatattcatcagaaatttccagattccgaaattttaagtctccatttatcatcagggctgtcaggaactgtccgcgctgctgaacaagcagccgcattgacaagtgctaagattacaacatttgacacattagcggctgaccgtgcgcaagcatttgttgtcttacaagcggcaaaaatggcgtcccaaggggctacgatggctgaaatattaccagcggttgaaaaagctcgtgatgagtcgcatatttttttgagttttacttctttgacaaatatggttgccggtggtcgcttgagtaaaacacaaggaattatcggtaatttgctaaacattaaggtcggtgctggtgtaacaaaaaatgatggcacggttgaagtactgctcaaaggccgaggcatgaaaactattgctaaattcaacaataatgttattgctaagatgcaagagtataaggaagtattgtcaataggtatctctcacgcaggaattccagaggaagcagctcaaattgcagcacgcttaaaagcaatttggcctgacattgaaattccagttttaaatacaacaccaattatttctactcatacaggcgtaggcgcattagcaattttgtaccgagcacgctaaaataaaaaccccagaattttatttctggggttttattgttgcattaaaattggtacacttaaaaagcatttatcaaaatcggcaatcgtgccggactggttcggaaaatcccagaataaaaaaccaagtgtgattgtattgtatcaataaaatcacatatgacagaaaggaaagataaaatgcaaaaagttataattgacacggatccaggaattgatgatagtttagcacttttggtcgcattaaaatcaccagagcttgatgttatcgccattactgttgtcgagggaaatgtccctacaaaaatcggtgttcagaatactctcaaagtgcttgaagaggtaggaaggactgatgttcctgtctttgaaggggcacatgaacccttgcaacatgagtacatcagtgcacaggatacccacggattggatgggttaggacaaagtaatattgctgtcccaatgatagaggccagcacaataagtgcccactcagcatacaatcagttactcaccaatcataatgatgtttgggtactggctttgggaccgttgacaaatattgcgctagccatgcaagaaaatcccaaggtttggcaaaatatgtcgcgcctaatcattatgggtggatcctatctttcgaatggaaatacctcaccagttgctgaatacaacttctgggtagatccgaatgcagctgattatgttttgaaaaatagtcctattgtagctgaaattgtcccattagatgttactcgaaaaatgttactgacaccaaatatcttgtcattaatgcagcgattgaatcctgagcaatcaatatttatcacaaaaatcattaagttttattttgattttcattggcaacaagaacacgtgttgggggcggttattaatgatccacttgtgattattcatgcattatatcctgagtatactcgtggcattagtaaatatgtcactgtagtaacagaaggtgtagccctcggacaaagcatagttgatatagctgatttttggaaaaaagaagcgaacgcagtgattttaacagaggtggattctttgcatgttatggcggaaatcatagctcgcctattggaaatttcgtcagcaaccatattgactgaattaaccaatattgccacagatcttgaggtattatcatgaaaaagctatctactcagcgtatcacgttaattgccttatttattgtgattaatattgttggtggtcacattgctttacttgccaagttaccagtttacttagacacgattggtacgcttttaggcgcatctttttttggtccagttggtggcgtagtcgttggtattttgacagcattaataaacggtacaacaggtgaccttttttcaatttactacatgcctagccaaattgttaccgctcttgtggcaggattaatttacagaaaagtcagcgctacggatgttaaaaatatttggtggtcagctttgatcatatccgtaccggcgacaattgtgagttcagtaattaccgtcattctttttcacggcattacttcttctgggtcaagcacgattgtacaggtgcttcacggtcttggggtcaaccaaacactttctgtttttctagtacagattggaacggattatctcgatcgcctgattggcgtgtatgttgtagccgtagtatatagtgttatcgtatcacgcgttcatttaatttaaatatcactttataaaataaaaaaataaagaacgaggaatacttgttctttgtacataatggtcatttacgctataatggttaccagttaagtttcaggagaattgcacatgcgaaagtttgccatcagtttaataaccatcttattgattggcattggggcattttatggcatcaaaacttgggaaaatcaaaaaaatgatttaaatcaacctcaaaaatcggtgcaaaaagtatcacatattaatttagttgcccttggggactcattaacagagggtgttggagacgaaaaaaatatgaaggggtattctgggcgcattgctaaaaaaattcgtgcacaatacaacgttagtgtcactgttagtaattttggtaaagcaggggatcgatctgaccaaatcaaaaaaagattggatacgcaacaaaaatttcaaaaacgattacaaaaagctaatgtgattgtaatgacctctggtggtaatgatttgcaacaattgcttttgaaaaatgttttggcaacgtctccaaagacgttgtcagctgccgttaaagcagggcaacaatcttatcaacaaaagttatctgctttgataaaggatattcgctcttataattctgatgcaccaatatttatatttggaaattataatcctttatatgttcattttgccgatcgatctgattttaatgacgacgttaagctatttaataacattaatgctcaagctgccaaagaagctggcaatgcatattttgtcagtattttcaatttaacgtatggtcaatttaaaacaacaacgcaacgagaagggctcattaaggaatcagctaactcaaatagcagttcaaattcgaatgctgccatgacagccgtattgacgggtcaaaagaatgttaacaacgcatggattagtacggaagacaattaccaccctaataataagggctataattacatgacaacacagttatttaacaaaatgaaaaaggaaacaaagcaatggctgatcaaacaatagctagatcaaataaaatagtcaaaaagaaaaagccaatttggttctggcttttttggggtctaatatctatattattggtaggtggaatctggcttttcaatgaagctagcggaccagtaaaaattaaggacaatgtatccaagatcagtaaatcagacgcgacgtttgatgtatccttaaataaaaaacaaatcaatgccttagttgctcattatcttaatgatacagataacagtggctatacttttaaaattggggatgacgtgatgatgtatggtagcgccaaacttttgggccaaaaatttaattttggcatggcgctagatgccaaattaacgcctaatgggaacatcgttatgcaggcgaaatctttagcaattggtaacctatcgttgccaattaaaactgtaatgagttacgtcagatcaagttacgatgcgcctgaatacgtcacaatcgtaccgaagaagaagcaaatattcattgatatgagtaagttacccacaacgcagggcattaaatttaaagcaaaggtcattaatataaaagcagatcagtttgttttccaaggaggtcttgctaatgagaaaaagtgatcgttcattttacaattggttaatgacgaatcgtaattctatggcagccaatgaagtgcaacaatttgcaaacaatgcctttttagattcgtcatttccaaaacaaagtagtgattttgatgaattgtcaaagtacttagaagagaatacaacctatttaatgagtatgacaacatttgatgaagcgtggtcactatacaacgctgagcgttaatgttagaaaggatatatgtttaatggcacaaataattcaatggttcccaggccatatggccaaagccttccgtttgatgcgggaaaatttaaaactagtcgacgttgtttttgagctggttgattcccgtattcccgaaagctcacgtaatccggaagtggataagttaatcggcaataaaccccgtttgttaattatgactaaagctgatttggcagatcctgatcaaacacgggcatggaaaaaacattttgaagcacaaggatacacagtacttgtgctcgacacgcgtgacccaagaactccgcaattagtgactaaagcagcccgacgagcagttgaagcaaaaaaagcagcacaactagcaaaaggtatccaagatcagcctattcgtgccatgatttctggggtgccaaatgtcggtaagtcaacattattgaatcacttggtaatgaaaaatgttgcgccaacggcggatcgaccaggtgtaacgaagaaaattgcttggctaaaaacaccaacaaaattagaattactggattctcctggggtgctctggccaaagtttgaagatcaaaacatcggcatgaaattagcattaacaggagcggtgaaagatacaatctttgccaaagatgatgctgcgctatttttgatcaacttttttcgagaatatcgaccagaggccattattgagcgatatcatttgaacgacaatatttttgatcaagaaaatgtagatgttttattatccatcacaagcaaattaggattcaaagacgattatgacaaggccagtgaacgaatactaaatgatcttagaaaaaataaactaggggcgtttacacttgatttaattgagacgaaaaatgactgacacaattgcaaatattaaattacaactcaaaaacacatctcctaatgacgagcagttgctaatttggcaacaagatcagcgtgttggtgtacaaaatgcattgaaggcttggcaaaaaaagcaagtgatgttgcaggaaaaacgcgagcattttttatctcgttttgatattgagcgtcagtactggatgcaaggctacgacttaattgctggcgtggatgaagttggtcgggggcctttagctggcccagttgttgcggcagctgttattttaccgcatgattttgatgttttagatgtcatagattctaagcaactgtctgcaaaaaaaagagacgagttgtacgacaaaattatagaaaaagcaatttctataggtgttggcagcgtcgaagcctcaattattgatgaaattaatatttatgaagcagcacgtgttgcgatgaccgaagcagtcaaccagttggctcccgtacctgaagctttattaatagatgctatgcggttagatttagatttgccgcaagaatttttaattaaaggagatgcacgaagtaattctataggtgcagccagtattattgcaaaggtcacacgtgatcgcctaatggcttcttatggtttaaaatatcctggttatggtttcgaaaaaaacgctggatacggtacaaaagaacatcttgagggtataaaaaaaatcggcattacaccgattcatcgtaaaacatttgcacccattaaagatatattatgatgcactgtaatatgactaagagactgattgccatcatccagtctttttttttgattacaattgtgttaaagtgtgtccgctcagcattttcggtaaatccatgtgaggccatagcttctgctaaacgagttgaccaccggagtgagaccaaaatagctttgaaaaataattgtggtgagtaaaatgttaaagattcaccacgcattaaagctgccgttcggatagtctggacttcttgtttaacacggggcacaaaggataatgcaccgcgaagaccgtagacaaaagtggttggcacacgaaatttttgttcgagtgtgtctagaagcaagattatgtcagttgtaaacgaaaaagccgctcctaggaatatgtaggcaacaattcgagtcatcatgataattgccatttcatgggaaccaaaagttgtaaatgatgtccatgcacctaagacaggcaagataggcatggcaattaatagcaaataacgtttccaagacagttttgaaaaaacaagataaataccagcaataatcgctacaacaacattgacttgataattaaggacaaaagttagttcgatgcttacgataagtataagtagaaatttaacacttggattcataaaaaatgctccatatattgtaaagttcgattagatagatgcaaatgataatcaatgattgggcgtagctgatctagttggtggctaataataataaaacgttgccgtccattatctgcgatttctcgtaaaatttcgcctacaacccgaacggaatctgtgtccagaccagcaataggttcgtctaacaataatattggtgtgccaacaattaacatcaccaagagttgaacttttttcttttgcccgccagagagctgataaacgacatgatcttgtagcccatccaaatttaagcgctctaagtaacgagtaattacgttttcggaccatttttctggttgttgcgcatgttgcatgctcaacgcgatttcctcacgaatcgtcattcgtaaaaactgccgttctgcattttgaaagatcaatgctacttgttttgcatatttagcagcattaaattttttgatattttgatctatatacaaaatgtcaccttggtaggattttagtcgagttagcgcattgaaaagggatgacttgcctgtgccatttgctccagtaaagagcgtaattccaccgggagccaaaggtaaatcagaaatactaattaattgacgttgccccactaaaagttcaaaattttttaattgcaaaacaccttctttaggtaattgcaggtggacattttgttctgataaaatacgattctgaaagttactaacagttgctacttttttgtggtgtatttcccacacatgatcaacaagtggttcgtacccatgtaaatcatgatcagtgattaatatagtggtttgtccctgtatttgtaaatctttcaatttagctaataggtcttggcgagattggctatcaatatttgcaaaaggttcgtctaataataagaaatcactttgcattgcaacaatgatagccaatgcaactttttgtttttcaccacctgataaggtgtcaatgtcttgatgagttaagtctgaaataccaacaaattctaaagcgtgcgttgcacgttgcttgatatcagaaggatgaacttgcaagttttctaaagtgaaaaccaattcatccagtggtgttttcataacaaattgggtgtctggatcttgaaataaaaaaccgacgactttggttttctcgttagccggtaatgtggtaactgcttgatcattaacaagtacttcaccttttagttgcggatataatcctgcaaatattcggagaagggttgattttccagagccagagggaccaattagcaggttaaaactattgtgagatattgacatggtggtatcatcaagtatttttgtattgccatatgacaaactgatatgttttaaatgagtaaccataataattccctatgtacgcggaaattccgcttatttatatttatctgttttctttgcaatggttaaaacatcagaatctgtagccatgtttattttgctgtataccatgacagggatgtcactaatttctgctgcaaccttgggcaaattttttaaaatatccattagttgatcgtaatcaccttcgagagttgattcgaaagcacctacctgatagttgacaccactcttgtcaatataagcaatcacatgatcaactatgcgaatgacttcttctgtgtcagctgtcatcggcaatacttggaccgcaatacttgatatcatgagaccacctcgtttttattgacctctaggatacctgatttagcaactaatttttgtgtgaagtaaacgataactcctgcaaaaatagctgctgaaatgaggcgagtaataaataatccaatcaacaaaccaaatgagtagtcagcataaccattacggaacaggtcccaaataaacgtcacaatggtaactgtgataacagacattgacaaactcgttttgtcccaacgacggtagccaaatacagcaaatccaagttcggtaccaaacccttgaattaatgcagaaacaacgttcatgacaccccattgagagccaaacaccatttcaattgtgccgccaagtgtttcacctataattgatgcgccaggacgacgtaagatgaacccagccatcggaccagccattagccaaggacccaatgttgcatcattagcatatgcgcttaatccaaatggtgttaaaaaggcagcgatgacattataaccaaatgcccaagcccaaaatataaatccaaaaaaaacaccgattagtgcgatgaagataacatcgcgaagtgaccatttgtttgcagacatttgcaaaacctcctaaaatttccgatattaaccaataggtgcatgagctatacaactgcttacatgacttattggttaataattgatgtaaccgaaatcaccgcaaaatcgggtgtaattagaaaaagccagacttcacaaggaagactggcttgaaaaattgtggtcatgatctcaatgcagaaacgctacttaacaaacttgtgttatttcatcatcatatattatagtgataacgttacaaaacatagtaccgtcaagatatgtcagttcattaatacattttcaagtaaatctccctacgctagtattaactagatcaggtgtgatgggttttatctcagcgcgacggcaccccagattttggtgttttcagttatttgtgaaaagctcacgcctagagtgtaacacaagacaaattatcgtgcaaactattcgtatgcaatagaatttaatcccaaaatcatgttatattttctaacattctaatgtttttaattatgaaatttgagtatgatgtaacttttggtctttattaattaaaagtacatgatatcagcgagatattgacttatttgttatactaaaatgagtaaaaaaaacaactctaaggatagaaaatggacagtattcatctttcaccacggcttgcagctgtggcttcatttgtacccaaaggcgcaagggtagccgatattggctctgatcacgcctatttacctgctaatctattaatcaataacaaaatatcgtttgcgattgctggtgaggttgctaaaggaccttacgaaaatgcgcagcacgaaattgttcgaagagcgttaaccacacaacttgaggcgagattggcgaatggattagcggcaattaaagatgaggatcatattgacacggtcacaatcgctggtatgggtggtgtcttaattacagatatattagaagcgggattttcaagagcaaaacgttttgaaacgcttatactacaacctaatactgatgagcacattgtgcgaacatggctaaacaaccatcagtataaaattaacgacgaggttattgaacaagaggataaccacttttatgaaattatgattgcaacaaagggcacccaaagtttatcaagcctcgataaaaaatttggtcctgtcttgcgaaagagaaaaacgtcagtttttgttgctaaatggcagaaagaattggatcgtatcgacacaatttttgaaaatcttgaatttgctggaaaagctgattcacccatttatcaagattggaaaaaaaaatatcagcaaattcaggaggttatcaagtgattgcacaagagttaattgacaagattgaactttttgcgccgaaacaattagctgaggagggtgaccccacgggactgcaaattggtgatcctaagcagcctgtacatcgagtaatgacagcccttgatgttcgtccagaagtagttcaagaagcaatcgataatcaggtcgattttatatgggcacaccatgaggtcatgttcttcccggcgaaaagtctagacttatcacagcctcaaaatcgaatgtatgcagatttgattcaacaccatatcgttgtttatgcttcacatactaatatggacagtgcacaaggtggcatgaatgattggttggccgaagcacttggcattcaagatgtagtgcctttagtaccaaatgtagataagaaaactggtcttggcaggatcggacaattagagcaaccaatttctgtacaagaatacgctgtgaaaattcgtgatttgtttcatgttcaagcagtgcgtgttattgctaacgatgtgacaaagccaattcaaaagatcgctgtgctaggtggagatggtggccgttggtggcgggttgcgcaacaagcaggagctgatgcctacgtcacagccgatgtctactatcacgttgggcatgacatcttggcttcaaattttattgtgattgatcctgatcatcatatggaagctattgctaacgaaaaaatggttgataaggtcaaagaatggtttggtgacactgttgatgtagttgctacaaaaatcaatacagatccatacaaatatatttagttaacggttaaaacagtgagcaaatgctcaaaaaggagtaatatatgacaaagtatcctgaattgacagaacgttttttgaagtatgtaaaggtagatacacaatctgatgagaactcagaaacagtgccgtcatcacctaaagaggtcgcttttttggcagatttagctgaggagttaaaagctattggtcttgaaaatgtacgcaccatgaaggatggttatgtgtttgcggaattatcaagcaatattgatgacagtgctgtgcctacaattggctttattgcacacgttgatactgcagattttaatggagcgaacattaacccacaaattattgaaaattacgacggcaaatcgtcaattaagttgggaaatagtggttacgaattgacaactaacgaatttcctagcttaaaaaaatatgcgagacatactctaattacaactgatggcacaacactattaggtgctgatgataaagctggagatgctgaaatcattacggcagctcagtatttaattgcacatccagagatcaagcatggtgatttgcgatttgcttttggaccagatgaagagattggtattggtgccgatcattttgatgttgaagcatttggtgctgacttcgcttatacaatggatggcggaccgttaggcgagcttgaatgggagacatttaatgctgcgagcgccgttatcacaattcagggacgaaatgttcatccaggaactgcaaaagatacaatggttaatgccattcaactagcatttgatttccatgaacaacttcctgtccatgatcgcccagaaaatactgaaggaacagaaggattttggcatcttctagcagttgacggtaatcctgaagaagcaaccctgcgatatattgttcgtgatcatgatcgaaatatatttgaagaacgtaagcaaagattattagatattgctgatgcctttaatcagaaattaggggaaaagcgtattaaagttgtattgaaagatcaatactataatatgggtgaaatcttgaaagatgatatgcgttcagttaatttggctgaaaaagcgatgaataacttagagattaaaccaattattgagcctgtccgtggcggtaccgatggttcaaaaataactttcctagggctaccaacaccaaatatttttgccggtggcgaaaatatgcatggccgttttgaatatgtttctacaactgttatggaacaggcaacagacgtcattttagaaattgtaaaacttgcacaagaaaaataacttttagataaacaaaaaaagagctcaactgagctcttttttaatcttgtgatttattcttcagacgcaacttcttttggtgcagctgatcctgaaattgctggaattgcaactagcgcaacttcaccaacaatgacagcaatgacagcaacagtaacaaaatcataagtaccagaattcaattgggatacaatataacccaaaatctcaccaaatattgccgaccaaattgctaccataatgtatttcatgatttttacctctttactgtcattataatacaccttttttcacaaatggcaagtttttaagggaatttaaacaagaaaatagaaaatgtctaatctgtgattttacggaaccctaatatttgttaaaattaacgacttttctgtgatttttctgtataattaaagaaaacggatgttcgtataaggagttgaaatgtacgcaccgcttcaaattttaagcagttatagcttattaaaaaatccaaatacaattgaacaaattgtccaaacggcaaagactcgtggttatgaagccattgcactggctgatgttaatgtaatgtacggggcgatagactggtttcgacaaacaaaaaagcatgggattaaacctttatttggcttgacattaatggtcaacggacttgtgaatactgccacgctatttccagtcgtactattagctgagaatcaagtaggctaccaaaatctaatgtggctatcatcagccaagatgactagtcaaggagattttcagtgggaaacaatggttaaacacttagacggtataaacattgtttttccaactgacagtgagctcgttcagctcatctcttcagggtatgaggaagttaataattattggcaccaactcctcacccttgttgacgagcaccattcttttattggtattaattcgcaaatggcaccgcagatacaagagaggttagcacaatttagcgaacgtactggtggtcatatgattgctttagatgatattgattatcttaactcagatgatgctttcaccactcaagttttaaaagcaattgatgcaaatgttaaattggacgatattaaaattttggctcaacaacaaggctcacatattttaagagatttagctgtcgttcagcaagaataccaaggtacagaaatactaaagacagcctatattaataacgaattattggtatcaaaaagcaatgtcagcattgaatttaaagatacagctttaccaccctttgaaacaccatctggcgtgaccaacgcacagtttttagaaacgattgctgtcagtggattaaaaaaacgattgcaaggacataacgtgagtttgaacttgtacgaagaaagattgcagcacgaattaaaaaccattgaagtgttaggatttagcgattacttcctgattgtttgggacattgttaacttcgcacataaaaatcacattcaaactggaccaggacgtggctctgtcgctggatctttggttgcgtacagtttacaaattaccgatgtagatcccttgcaatttaacttgctatttgaacgttttctaaatgatgagcgagtgcaaatgcctgatattgatattgattggccaccaagcaaacgtgaagaactattcacctaccttcatcaaaagtacgggaaaagaaattttggtcaaattattacatttggtactttagcttctaaacaagctctacgcgatgttggtagggtgtttggattaccaaccccgacattgagcaagttgagtgctagtatacctgaaggaaaaaatggacgtaaggtgtccattgatgatgcgcttaaagcaccacaattacagaatgcccttcgtgatattgataatggtagattgttattacaaacggcgttgaaaattgaaggcttaccaaaaaattactctacacatgcggcaggaattgtacttagtgcgaatcctttggtacaaacattacctgtgcaatctggtacggagggacgcttattaacacaatttgaaaaagatccggttgaacaattagggttacttaaaattgatattctaggactacaaaatttagccattttaagccaggcactctattatgctcaaaaagagctaccagaagggtttgatattaccaaaattgctttagatgatgccaaaaccttagcattatttgctaaaggtgacacaaatggggttttccaatttgaatctgcaggcattaaaaatgtgttgcgaaagctgaagccagccacctttgaacatattgtggctgttaacgcgctttatcgtcctggtcctgcacaaaatattgataagtttatcgctcgacgccatggtaaagaagcagtgacgatcccagaccctagtttgaaatctattttggcgcccacttttggtatcattgtatatcaagagcaagttatgctagttgcggaatcatatgctggattcacgctaggtgaggcggatgttttacgaagtgccatgtcgaagaaaaaagtcgacaaaatgcagaaattgcatgaacaatttattaaaggcgctttaaaaaatgggcatgatcaaaaacaagcagaacttattttttcttatattgatgaattcgctaattatggttttaatcgttctcacgcagttgcttatagtaaattggcttttgagctagcctatctaaaggcacattatccagttgctttttttacagctctattaaatgcaaatctgggtgagcagaaaaaagtgcaacaatatgtttctgaagccaaaatacgcggaattgtagtattagcgccagatgtcaacaagtcatataagttttggacatctatcgaaaaccaattacaaatgggtttgaataatatccgtggtgttcgtacagactttgtgactagtgtattggaagagcgacagaataatggttcatttcaaacaatccagtcctttgtaagacgtttgccagataaaatgcgtaaacgagaagtgttagagcagctagtatatgctggtgcacttgattcgtttggctataatcgacgcgaactaatcgaaaatatagcgagtttgattgaaggtgcaagctttggtaacttaattttggaagaaacgaaaattaagaagtatgatgattttgctttgtctgatcgtctgaaaaaagaaaaagaagtcattggcgtaaatttatcaggtcatcctttagatacatatgttgatttcattttggaaaatggttttagtcaaataggaaatgtcgtacagcccagtcaggttgaaaaaataatcgcaattgtcgacagtattcgccagatccgcactaaaaaaggggatgacatggctttcgtgaaagtctctgataccactggagaaattagtgtaactatattcccacaactatttaaaaaaataagcaattttctaaagcccggaacgatattgagtattgctggtaaatcagagcgtgatatgcggaatgaaatcgctattgtggctaatcatattaatttagcgccagaaccccagcgcgttcaacctattcaagggacctggtttcttcagcttgacgaaaagcatgacacaccgcaaagacgtgaggaaatcagccaaatcatgaaaaaacatcatggccataatccagtggtgattcactggcaaaaagatggtaaaaatcaaaaacttgatcaagaattttggatgactagtgaaaccgttatcatgcgcgaattagcagctttactaggtagtgagaatattatttttaaacaaacttactaataatatgacttgtacaaatgggtcataatgtataaaatagagattgggtagagttgcacaagcaacaaccaagataactaaggagctatttaaccatgaaaaagacgaaaatcgtctcaacacttggtccgtcatcatctgatgtcgaaacaatcgtaaagttaatccaagcgggcgccaacgtattccgttttaacttttcacacggtgatcacgaagaacatttgggtcgtatgaatgctgttcacgaagccgaaaagattactggtaagacagttggtattttgttggacactaagggtgctgaaatccgtacaacaaagcaagctgacggcaagatcgaattccatacaggtgacacattgcgtattgcaatggatgaaaaccttgaaggaacgaaagaaaaaatcgccgttacatacgctggtttgttcgatgatgttaaagaaggtggacaagtcttgtttgatgatgggttgcttggtacaactgttatcgaaaaagattcagccactcgcgaattggttgttcgcgttgataatgatggtattttgggatcacgtaagggtgttaacgcacctggtgtttcaattaacttgccaggtattactgaaaaagatgctgatgacatccgttttggtttggatcacgaaatcaactatattgctgcttcattcgttcgtaagcctgaagatgtgcttgaaattcgtggactattgaaggaaaagaacatggaacatgttcaaattattcctaagattgaatcacaagaaggtattgacaaccttgatgcaattttggaagtttcagatgccttgatggtaccacgcggtgacatgggtgttgaaattcctgctgaaaacgtgcctttggttcaaaaagacatgattcgcaagatgaacaaggcaggtttacctgttattactgctacacaaatgcttgactcaatggaagaaaacccacgtcctacgcgtgccgaagcttccgatgttgccaacgctgtgtttgatggtactgatgcaacaatgttatcaggtgaatcagctaacggagactatccagttgaatctgttgccacaatggctgctatcgacgaaaaagctgaaacttcattgcgcgaaaacggtcgtcatgaggatattttcttcgatgagactgattcaacggaagctgttgcagcatctgttgctcgtatcgcacgcaatgtgaacgctaaggctgttgttgtatcaactaactctggttacactgcacgtatggtttcaaagcaccgtcctgatgttaacattttggccgttacttattcagaacgcgtacaacgtggtttgacattgaactatggtgttgttccagtagtttatgatgcaccaaagactattgacgaaatggttgacttagctaagaaggccgtaaaagaccaaggattggctaattcaggtgatactattgttattgcagcaggtgtaccaatgtcacaatcaggtacaacaaacatgttgactgttcaaacagtataataattctagtttatacttgtaaaaaagactataatgatttgattattcaaatcactatagttttttttaatttaatgtaagaaaagctaccacagtttaatactaaaatttaacgaactgctaatattaaattaataataaaaaaacaagtaggagtgatttaatgaacagtggtgatttagcatgggttttagtttcagctgcattagtctgggtaatgacacctggattagccttgttctacggtggcttaggtgagcgtaggaacttgttacacacgatgtttattccagttatgattattggaattgcttcgttagtatggtttgttgttggatatacgttatcatttggtggtagtggaaatgtgattggtaattttaaacatttgttcttaacgaatgtttcattcacgcattctactaaagatttaacaattcctgacggtgcatttgccctgttccaaggtatgtttccgataataacagccgcaattattactggatccgtcattggtcgagttagaattaaagcattgctcgtatttattgcactttggttgattttcatttactcaccgttagcgcacatggtttggggcggtggcttcttggctcagttaggcgcaattgattttgctggtggaactgttgttcatatttctagtggtgtaactggattggtgctggctttgatgattggacatcgtcatattgacaagcacatacctgtacgaccttcttatgttttgattggtggcgctttgttatgggttggatggtttggtttcaactctgggtcagctcttgcagcaaatggcacagctgttctagcattagttaacacgtggttagcatcagcggcagctgtattgacttggggtcttgttgaatataagtatcatggacgtgctacattatccggtattactagtggtggtgttgctggtctagttgctattacgcctgctgctggttttgtggcaccatgggcagctgtagtgatgggactcttagctggttttataggctttgctggtatcacatttgttaaaaatagttttggatatgatgatacattagatgcttttggtattcatggtattggcggcgccgtgggtgcaatattgacaggtgtatttgctgataaaagtgttggcggtgttgctggtctaatcaacgggaatatatcattggttggtaagcagttagtcgcaattttatttactatcgcatttgctgcgattggcacatatgttttagctaaaataacagaactcattgctgcaccactgcgtttgacagctgatgaagaagctgaaggttatgacgcaattatgcatgatttgactgtggaataaaggacaatggtcctttttattttgcctgatatttagtgcataaactaccatcaatcacggcaatatggtagaataaaggaaacatataaaggggatttgctttttgacagcacaagttcagcaaatttttacatttgaaaatgtggagcaacagactaagttgcttggcgttaatgataattttttacagttaatcgaagaaggattaactgtgcgacttcatgctcgtggtgaccaaatgaccatctcaggtgatgaggataaagtgccattagctaaagctgtactacgcgaattaactagattaattaagcatcaaattaatatatccgatactgacgttgtgagtgcaataacaatggcacagcgtggaacattggaatattttggtgacctatactctgaagtactaattcgtgataataaagggcgttccgttcacgttaaaaattttggtcaacgccagtacgtccaatcaattcgtaaaaatgatgtcacgttcggcatcggaccggctggaacaggaaagacttttttagcagttgttatggcaatatcagccttgaagcgtggtgacgtcgaaagaattattatcacacgtcctgctgttgaagcaggtgagtcactaggatttcttccaggtgatctgaaagaaaaagtagatccatatatgcgtcctatttacgatgctatgaatgcattaattggcgcggaacagacccagcggttaatggagcgtggtgtggtcgaaattgcgccactggcctatatgcgtggtcgaacattggatgatgcatttattattctagatgaagcacaaaatacaacgaatcaacaaatgaaaatgttcctaacgcgttttggatttggctcaaaaatgattattaatggtgacatctctcaaatcgatttgccatatggtgcaaaatccgggctcatttcggtccaacgtattttgaaagacgtgaatcatgtatcgtttattcattttggtagtgccgatgtggttcgtcatccggttgtcggtctaatagttggtgcctatgaagcagctgagaaaaaattagccgaattaaaaaaggagcaaattaactaatggatttggctattattgaccaaacaaaagctggtgttaatcaatatcatcaggatctggttcgttgtgtactagattatgctggcaaatatttggaattgccagataatacagaaatgtctgtaacatttatgaacaatgaagaaattcatcaatacaataaaaaatatcgtggtatagacaaacccactgacgtcattagtttcgcaattgaggaagacggtgatgatcttccggttttaccagacgaattgatggatgccgagttagcgaaaaatattggtgatatcctggtttctgtggatattattaattctcaggcagagtacttggggcatagctatgaacgtgagttaggcttcctagtggtgcatggcttcttacatttgaatggatatgatcatatgttaggcgatgcagaagaaaaagaaatgtttgatttacaacgagagattttagataattatggcctcaaaagataaaaagctagaaggtgcgcctaaagactacaataaaaaagtacaacgaaacagtacattttttcgagccatgagaaactctttgcacggtatttggctgatactagtcagagaacgcaacatgcgaatacatatcttgctaggatttctcattttgcttgtgggcttacatcttggcttaaaccgtgcagattggttgtgggttgcggtcgcagtatttacagtgatatcgagtgagtttttgaacacgattattgaagctgtggttgatttggttgtcgaaaaaagatatcatccacttgccgggctggcaaaagatgtcgctgctggtggcgttttagttgccgtgggttttgaaattattatcttattgattgtatttcaaccttatgtttggcggcattttggtattgttaccaatttttcacaatttattcatgactttagtaaataaaacacatacaggagaatgcggtcaaagaccgtatatatattatgacagaatctacttttaaatcaggatttgtggcgattattggtcgtccaaatgttggtaaatcgacgcttttgaaccgcatcgttggcgaaaaaattgccattatgtcagataaagcacaaactacccgtaataaaatacaaggcatctatacaacggatgatgcacaagttgtgttcattgacacgccaggtgtacataaaccacaaaattcactcggtgattttatggtaaaatctgcattttctgcgcttcatgaggcagatgcaatctggtttgtggtagatgcttcaatggcacgtggtcgtggtgacgatttcattattgaccggttacaagaagttaaaaatacaccaatttatttactaattaacaaagttgatttattagcgccaaatgacttgcttgatgttattgctagctatcagaatgatgcgcctgagtgggctgaggtatttccaatttctgccacagagggtgataatgttccagagttgttggacaatattgtgtctcacttggatgaagggcctcaatatttcgatgcagaccaattaactgatcaccctgaacgttttgttattggagaattaattcgcgaaaaggtattgcagttaacacgtcaagaggtaccacattcagttgctgtcgttatcgacaaaattgctcgtgaaaatgaagaaaaaattcatattcaggcatcaattattgttgaacgaccaacacagaagaatatcatcattggtaaacagggtgcgatgatcaaagatattggtacgagggcgcgcaaggacattgaacgcttactcggggacaaagttttccttgaaacttgggttaaggttgagcctcgctggcgtgaccgaccacaagctttgcagacattaggatatcgtcaagaagattactaaaatgatgttgtatcaaagcaccgtgttgtcataaagaaaaattttggcgattgatttagtggagtcattatggcaattattcgtggcattgtattgtatacacgacaatataaagataatgatttattagttcgcatactaacggaaacgtacggcatgcgaacttttttggcgcgaggtgcaaagaaagctacttctaaactctcagctggtacacaaccttacacaattgtaacttttgatggtgctctaccgaaacgagaaaccggactaggttacatgaatgatgttcaagatataaaagtatattcacggcttatcgaagatatcgaagcaaatgcctatgctgcgctgatcgctagtttaattgatgcttcctttgaagaaggggaaaagataacacgttggtataatcaactttatgtcgcgctacagaaactagatgagggactcgatcctcaaattattgctaatatttttgaaattcaattacttgttcctctaggggtggcgccaaacttaagggctgatccgattacaggtcaagtagatgggaaatttgattattctgaaaagtacaatggcattatttcagaacatcattttaatctggacgatcagcgattaatgcttgatcaaaaaactgtgttttatttacgtcaatttagcgtcattgatatgcgccaagtacatgacatcaaaatgtcagcaatcaccaaacgtggtttgcaacgtgtaattgactatatttacgaaaaacaagttggtttgaagccacgtgcaaaatcatttattgagcaaatgcattcgtggcaaaatacgttagttaattttagaaggaataagtaatcatgaaaaaaattttggttttgcataccggtggtacaatttctatgcatgaagatgctgatggcgatgtcgaaacaggatctgaaaatcctttagttcaagcgaaggttacctttccaaatatcgaactagaagttgaaaacatttttaatttaccaagtgaacatattggtccgtctcatatgctacaattgcaaaaacgtatctctgaagccaaaaatgattttgatggtgtggtcattactcatggtactgataccttggaagagacagcattctttctggatagcacattaaaagtttcgtttcctattgttataacgggagcaatgcgttcatccaatgaacttggttcagatggtttgtacaattatcaatctgcgctacgtgtagcggcagatgatacatccaaaaaccgtggtgtgatagttgtgatgaatgatgaaatacatgccgctcgatttgtaactaaaacacacactactaatgtggcaacgtttgcgtcaccacttagtggcacgatggggctactaacgaaacgacaaattatttacttttatgacttgccacaacgagaagtattaccagatgtagatattaacaaaaatatccctgttttaaaggcatatgctggtatggatggccaattattgaaacttttggctgatgccaatattgacggcattattattgaagcacttggcgctggtaatttatctcgtgaagcagctcgcggagtagcatatttattagcgaaaaatacgccagtagtcattgtgtcaagaagcttcaatggtgttgcagcaccagtatatgattatttaggtggcggtgttcaattagagaaatctggagcaatctttgcgtccagtattaatggccctaaagcgcgactaaagctattaatcggattatcaaacaacttaagtaaagaacatctggaaacgtatttacacggtatttaatacattatgagaaaaatctatttcgtgcgccatagcgtacgtgatgctaaaattaaagacgattattcggcaccattaacgatagaagggaagcagttggcccatgatttggtgggttattttgtagacaaaaatattaaggctatctattcatcaccttatcagcgtgcgttgcagactattgaaccaacagcaactacactgggtatagaaattaatttgaatgctgcattgcgtgaacggcaaactaatgaccaaatagattggcaaaatcatttagaaaagctgtggcaaaatttttattttaaaaccgctggggaagaatctttagcaactgtgcaacaaagaatgaaaacagctttttatcaaattattgatgaatcttctggtgaaataattattacaagtcatgggacggcattaagcttattgttccattacttaacaagtggttatttcaattttatagactggcaaaaaatggaaatgccggatgtatatattggcctttttgatgaaaataatcaatgcatcagtttaacaaaagaggcgtattaactttaatagttaatacgcctctttttaatgtcatttaaagatatttgtatagattgcttctacagcactatcagataagtcaggctgaattcctaacataatcgaaatttcgctcgctccttggttaaccatttgtagactgatattacgctccttcaggggcgcgacaatctccgtcaaggcaccaacacgattacgcattccttcaccaacaaccattataataccgtagcttggaatccactttaatgtatcaggtttaatttcagcagcaatatcgcttaacatgttatcaacttgctcttgtgttaacattgttttatcaaaaataattgtcaaatcatcaataccagaaggcatatgttcgtaagaaatattgtgacgcttcaaaatctcaagaatacgaagggtaaaaccaacttgtttattcaataagtaccgatgtaagtatagggcagcaaaacggttggagttggcaataccagttacaggacgtgtttgctgaacctctgtaggtggtacgataaatgttccaggggcatcgggatcattggtatttttgatgtttatacgaataccaccttgaatggctggaataatggcttcatcatggaatacagcaaaaccagcataagataactcgcgcatctcatcgtatgtcatttgttggatagctgctggatgttcgacaattgaaggattaacagcatagatagcactgacatcggtaaagttttcatataaatcagctcgtagtccgcgtgccataatagcaccagttatgtctgaaccaccacgtgaaaatgtagccatgtcgccattcttagtgtagccaaagaagccagggacaatgagtcgttcagaagttgacaggtctaactcgccgattgtggtataagaagcggtatcaaatgttgctgatcgcgcattatcatccacgaccaatccaatctctttaggatccacaaaacgagctggcatacctaaatggttaaagactttagcaatcaattgcgcatttaaatattcgccgtgagcagcgaatgctgcatataaataatcaaatgatcggtaatgttttcttgctagatgttcaatttgttcatcgaggtcagctagttcataatctggtaactcaaagtattcaccaatagagtgatagcgatgtttaatcgtttcaataatttcagtggtatcttcgtctgcaagcgtagcttgcgcgtatgatatcaataaatcggtcaccttccgatcatctttgaatcgtttaccaggtgctgagacaacaacaacttttcgatcatcatcagcacgaatgatatcgtagacacgttgcagttgttgaccgttagctagtgaagaaccaccaaattttgtaactttcataatatgtaagtgctggtaagcacatattctcctaattattttttgtaatttgtaaaccagtataatctggttctagtaataatagttttcctggcaaagccatgtttgtcagcacttttaataacttagttgcattatcctttgatacgagagtgataacagtcggacccgcaccagaaagataggtgccgatgatttctagttgatgggcagtatcacgaataatttttaggtgtggtgctaaatgagcacgagcctgttcatgaaattggtccttttcaattaaaacacgagctgtattgaaatcaccggcgttcaatgctgcggttaaagtattactgatagcgctggcagcaacactatctttaaatgtcatcttagcaggcaatgcattacgtgcttcagttgtgagcagttcgtaattcggaatgaaggtgatgaaattaatgtcttttggtaaactcaatggtgcatgatagacctgctcgccatcgtaaaaggctgctacactacctccaagtaacgcaggagcaacattatctggatgaccttctaaagccgtcgcttgcttcaataaagcgtcattactcaatcgcatatcagccagaacattggccattgctagaccagccaacagcgcagaagatgatgaacccagtccgcgtgcaagtggaatatcagattttacaacaatacgatgaggtgtcaagtttggggctaataagagtgctgttttgacgatgaagttgttaacatcactgggcatatttgcaccgtaatcatgaatcacttgccattcggaggtttcttcatacacttctaaggttaagtatagttttaaggccacgccaagagaatcaaagccagggccaatattggcgctagtagctggtacagttattttaatcatgagaaaattttatactccgccgctaaattaatgccatcagcatttcggattgttgtacgaataacattgagctgcgcatcagaggcagcgtgtgtcagagcaactaatcgagcaaaaccattttttgctggggtttgcttcaaatcagtaaaacttatttttgcggaagcaaacataccggttacggaatacattgctcctggcgtgtcagctacttctacaacaataaaacgtcttgccacgcgctgtgaaggtttagccaaatctagatcttggttaaaagtattaaatggtcttcctggcgtattcagcgctagattggtagcgacattggttaaatcacttaataccgaattagcagtaggcatttcaccagcgcctggtccatatagcatcacttcaccaactgactcaccattaactaaaacggcattgttttcattattaacggtcgctaagggatggttaaacgaaacaaggtgaggggaaacctcaatactgagtgcattaccaactctttgggcaacaccaagcaatttgattgcgtagccaaaaccatgcgcatcgttgatatctgaatccgttaagtcggcaataccagtaatagttacgtcatccataacaggttgcacaccaaacgaaaagttagacaaaatgattaacttgtatgctgcgtcaaaaccttccacgtcatttgtgggatcagattcagcaaaacctttgtcttgagctaatttaagggcttctgcatacgttaaaccatttgtagccatttgcgttagaataaagttacttgtgccgttaatgataccggcgacacgtgaaatctcatctgccgtaaaactgcttgaaagcgtacgcaagataggcacgccaccggcaacggcagcttcataatataaatcaacaccattctggttggctaattcagctaactcttgtccacgacttgcgattaaatctttgtttgccgtgacaacatgcttttttgccataagtgcgcgtttgataatatcgtatgcataatcaattccacccatgacttctactacaatttgtatttcgtcattgcctaaaatatcctcaggattatcagtgattggaaaatcttgtgtaaaacctgtgcgcggtttattaagattatgtacgacggcatgacgtacgaccaaatgagatcccgtgcgttgggtaatttgattagcgttttgttgtaaaatttttacgacaccacttccaactgtgccgagaccaaaaagaccgatgcctatttccatgtgatattccctttattttgagtattttatatatgttcttcttatgattttatcattataatatctaaaaataaacaaatttgttataattggataaattataaaaaaaggaatttagttactatgaattatgtatcaacacgtggacaggcgcctgcagttacatctagccaagcaataataaacggtattgcgccagatggcggtctttacgttccagaaaaatggccaaaattaaaattagattggaaaaatctaagccagcaaagctatcaagaaattgccacgcaagtatttgatgccttttttgatgattttacagttcaggaaattgaccatattatttcaaaatcatatggcaatcaatgggatgctgagagcattgtgaccttgcacaatgaaaacaagttgcactatattgaattgtttcatggaccaaccttagcattcaaagatgttgcactacaggcactaccacatctattaacgacagctgctaaaaagcagtcactaaatgataaaattgttattttaacagctacatctggcgatacaggaactgctgctatgagcggctttgcaaatgttgaaaatactgaaatagttgttttttacccagaagttggtgttagtgatattcagcgtcaacagatgcaaactgaagagggacacaatgctcatgttacagcaataactggtaattttgatgatgcccaaaaagctgtaaaatctattttgagcgatgagaaattaattcaggaattatcagaaaagggtatgcgtttttcatcagctaattcaattaatattggtcgattagtaccacaaattgtgtattacatttatgcttacgcccaattagtaaaaaatgatgtggtggtaccaggagaagaaatcaatattgatgtgccaaccggaaactttggtaatgtgcttgcttcatattatgccagtcagttaggattaccagttcatcagtttacagttgcttcggatgaaaataatgtattaactgattttttcaacactggtatctatgatcgtcaacgtgattttaaagtcacaaattcaccggcaatggatatcttagtatcaagcaacttggaacggttgttgtattttgctagtggtcgtaatgatgaagaagttcgccagtatatgaagtcattagctgaaaatggtcaatataccttgactgataaaacgcgtaattatttgcaaaaattcacagctaaatttgcgacacaatctcaagtggttgatacgattaaagatgtctttgaaaatagcggttacttaattgatccgcatacggctgttggtcgctttgcttacgaagaagaaacacatcaaacgttacttgcagcaacagcaagtccttataagtttccacaaacagttttggcagcattgcaggaaaaaaacgaagggggcgtagtggatttgcaaaagctagctgaacgaacaaatacagttattccagcacaagtagcaacgttatttgataaaactattgtacacactaaaatcatcgagcctgcgatgattatgcaatctattaaagacgaactatctatctgataattgtgggattgtttgctatattatgacattttatgatttaaatcgttgattttttaatgtataattaggctatatcaaccaaggagaatcaaatgtcatatcaagaattagatcctattgtctggagtgcgattcaacaagaaagtgcgcgtcaaaaccgtacaattgaattaatcgcttctgagaactttacatcgcaagccgtacgtgccgcacaaggttcggtgttgacaaataagtatgctgaaggatacccttataagcgttattatggtggcacggagtacgtggacgttgttgaacaggtagccatcgatcgtttaaaagaactttttggtgctgaatatgctaacgttcagccgcattctggttcccaagcgaatgctgctgcttacatggcatttttaaagccaggtgacaagatattgggtatgagtcttgacgctggtggacacttgacacatggggccaaggtcagtttctctggaaaagtttatgaatcacatacttatggattaaattcggaaacagaaaccttagattatgaagcaattgccaagcaagcacgtgaagtaaaaccacagatgattgtggccggtgcttctgcatattcacgaatcattgaatttgataagtttcgtgcgattgctgacgaagtgggtgcctatttaatggttgatatggcgcatattgccggacttgtagctgctgggctacatcccaatccagtaggcattgcagatgttgttacatcaacaacacataaaacattgcgaggtccgcgtggtggggttattctatcacaggaaaagtatgctaagcagcttaattcagctattttccctggatcacaaggtggaccattggaacacattattgcaggtaaagcaattgcctttggagaagctttacaacctaaatttaaagactacgcacaacaagttattaaaaatgcgcaagctatggcaaaagtttttaatgatactgaagatattcgtgttgtagctggtggcactgacaaccatttattcaatttggacctaactaaaacagcgttaaatggtaaacaaacacaggaattattagacacagtttcaattactacaaacaaagaagctctgccaaatgaacaattaagtccatttgttacatctggtattcgtattggaactgcagcaatcacaacgcgtggatttgatgaagatgatgccactaacgtagccgaattgattgtgacagccatccatcattatgatgatgaaaaagtgctcaagcaagtgaaacgtgaagctgaagcattagcaatgacgcatctatttgaataatttaaaagctggtaaaaccggctttttttggtgaaaaatgcaaacaaaatcagaattaagaattcaacaaaaagcagctcttgctagagaaaatctgatgaagcgtaaaagggaagaggagcaactttatgcactacttttccagacgcctgaatggcaatctgctgatagtatagcagttactttgagcatggagttcgaattaaatacgagtccgattattattaaagcctgggaaaaaaacaagcgagttctcgtaccaaaaattattaatcacaaaatgatttttgtggaaatagattcaaatacacgttatcaaacggggatgttgaacattagagagccactaatagataactatcaggccgttgaacaactggatctggtaattgttcctgggttagcttttactgttagcggtaaacgtttaggttttggggctggatattatgatcgcttcttagaacactacgcggggcatacaatcagtgtagccttatcgacgcaattactagatgatttaccaacagaaaatcatgatcaaactgttcaacgtattttgtatgcaaaatagctaattccttggtgtagcactatcatccatttttatcaatgtttgacttttggtaaatgttttcttacaataccaatatagtaggtaaaggggaaattatgcttgacaaaacaatttataaacagatttttaagtctagtttcgacgccccaatcgacgttgaattttgggatggggaaaaggtaagttacggtcaaggagacccaattgccacaatcatccttcacgaggtcataccgatcaaagacattatggcacatgcctcgctcacttttggtgaagcgtacatggatggaaaaattgaaattaaaggtaatctacaacagttggttaagattgcgtatgattccaaagaaagttttttgaatggatctaagttttctaaacttattcctaaacactcacactcggagaataagagtaaagcagacgtacagagccattatgatattggtaatgatttttataacatgtggttggatcccacaatgacttattcttgtgcttacttcgttagcgaaaaagatacgcttgaagatgcacaatggaacaaagtacgccacattttaaataaacttcatgcacaatctggtgaaactttattagacatcggatgtggctggggcacattactgttcaccgcagctaaagaatacaacttggaagccactggtgtaacacttagtcaacaacagtatgattttgtttctaataagattaaagaagaaggacttgaaggtcgagttcatgtttatttggaagactatcgtgagttaaaagatacgtatgaccatgtaacttctgttggtatgttcgaacacgtcgggaaagaaaacttaggtgaatacttcaaccaagtgaacaaccttctcacagaaaatggtacagccttaattcacggcattactgggcaacatgacggtgcaggtgttgatgcttggatcaataaatacattttcccaggtggttatatcccaaatatagcggaaaacgtgggacacattattgatgcttctttgcaggttgatgatattgaaccgttgcgtcgtcattatcagaaaacattggaaatttggacagctaatttccacaaagttgaagaggaagttatttcaaaatatggcgaacgtttttacaggatgtgggatttatatttgcaagcttgtgcaggttcatttgaatctggaaatattgatgtcgttcagtatttgctcaccaaagggccttctggtacaaacttaccaatgacgcgttcatatatttatcatgctgatgttgctagcggtgtgaaatagcgtgtaatctcgttagattagtaaaaagcagtcaactatgattagaagttgactgcttttttattgattaaaattcttgataaactgccggatcttgattatttgtcctgccatcaggttttgttagatcgttgatacgttgcatatcagatgaactaatttcaaaatcaaaaagatctagattacctttttgtcttgcataactacttgctttaggtataggcaatacgccaagagatatttcccatttcaacacgagctgaccaatattcttgtggtattttttagctaattcaactaaaacagggtctttcaaaatcgcacttgcacgacccaatgggctccaagcctgtgttaaaatattttgagtgttattgtattcacgcaattcctgttgattgaaataaggatgcaattcaacttggttaacaactggtaatatattggtttcttttttcaaacgttcaatatgttcaggaagaaaattgcaaacaccgattgatttaacaagaccaaacttttgcgcctgaatgagtgtgtgccaagcctctagataatgatcatcaatcgggttgggccaatgtaataggtacaaatcaaagtaatctaacttacttcgatacaaggattcttgaattagatcaattgagtcttgataactactgtaatacttccctggaagctttgaggtgatgattaattcatcgcgattgacatgcgattgttgtatagcttgtccaactgtaccttcgttctggtaattaaaggcagtgtcgaatagacgataaccagcatcaactgcggataaaattgattgtgttcctgcaaagccatttaatttatatgtgccgaaaccaatttctggtaagtgttgaccatcgcttagttcatgaaatgtcataaatatagacctactttcttcgtactataatccctatagtaggtcaagaatttaggagttgcaagagaatggtttgctcactagcaaacaaaaaaacatcatctaagtaatgtttttaagtattagtatattttaataattaaaataccaaccaacatgccaataacgccaattatttgatagatagaaattgattgctgttttgattgaaataacccaaattgttgaatgagcatggcgccaatcataacgcctagtgttgaaatactaaccgtgagacctggacctaacggtaggatgagaagtgacataagggttacaaaagcagcaccagctaaaccagcaaaccaagattgtgacagacggataccaatgcgcaaatgacgccaattgttgtttttcaaaaaagcgagcacgatcaatccgattatgaaggcccataatgcgctaacagtcgggctttggatgtaatgacctagttgaccattaaaggtagactgcacagtgcataaaataccagcgctaaaagcccagagacgatttagcatttgtgattttgaatgctcactacttgccaattctatagctgaatgtcgagccgataacaccacggcaatataagtgccagctaaaagaatgatgataccaatgatgcgagtcactgaaaccataacaactgttgtattaaaccatccaaaggtttcaaaaaacataccggataaaatttgccctaatgttggaaacatgactgtttccacagacccaatttttgggaaaagaataatacaacttgtaatgaataccaatccgaaaagaccacctgttgtcatccatattggtgctgagaagataagctctatttttgaaaagtcacccagaacaacagtcagaatgagcaataaaaatgaaccaactatatatgccataaaacaagcaacgaagggagatttgagcaaaaaacttaactgcgcgttaacggcattttgagcagccaaaattaaaccagctccaatggcaagtgcaatatatatcatgtacatcagtttatctccacatgagcttgctgtcgttctttaatttctactgtgttatcgccaataattattcgatcacaaatatttaaaaacaaaccgtgctcaacaacgccaacttggctttcaagatattcggcgagggcatatggattgttaattgtggtcatatggcaatcaataatgtagtgaccagcatcagtgataacgggcttgttatttccgggatgacgacgtagcttgggaaatagacctttattggcaaattgtcgtaacaactgaccgctaccgtaggggataacctctacgggcagcgggaaagaacctagcgtgttgtgcactttactgcgatcaacgatccagatatttttctttgagtttttagctactattttctccatcagtagggcagctccgccaccttttataccgttaaggtaggaatcgacttcatctgaaccatcaactgtaacatcaatatggtcaatggcatcaatgtcgacaattggaatatttaattctgcgcatcgctgactagtaattgttgaagtggtcacgccgatgacgttatattgagaagcagctaaagcatctaaaaaataagaaacagttgaaccagttcctagtccgataatcatatcggtctggatataatttaaagcggcgagggctgcttgttttttttggaaatttttttcattcatgataagcctcattccgccatagcagcattagcaagcaaaccagcgtcaacgtcttttttatttggaatcgaggctattgcaccagatcggctgacggctattgaactagcaaagcaactacgtcgaatgacacttggtagattcgacaagttgtcgtcaatattagctgaaaaagtaccaatgaatgtgtcgccagcagcagtggtatcaacggcatttaccttgaaaacaggtaaaatatctgccgacccattgacatgatagtaaacaccatcactgccaagtgtaaccactacgttggaaaaacctactttatttaatttggaagtgagtgccgttaacgatgattgttttgtggttggctcagtgtgagctagtgccgcggcttcagtttcgtttggtatgattaaatcagtagatgaaataatatttgaatcaagatgtgacgtaataggtgccggatttaatatagttagtacgccatttttcttggcgatattaaacccagcaacaatggcttcagtaggtacttcaagctgtgcaacgattacatcagcattagcaattatattgcgcgctttttccacatcggcgctggttaaattcatatttgcaccaccatataccataatcgtgttatgtccatctggctccaacattatagtggcggaaccagtaaactggctctttgtaaaaatataatccgttgatattccttcatcacttaataattgtttgaaggcacgtccacggtcatcatcacctacagcaccgatcattgttacatcagctccttgacgagcagctgcaactgcctgattggcacctttaccaccaaatgtacttgcttgattgttaacggtgatggtttctccttggttaggtaatctatcaatcatttgaatagtatcaatattgagactaccgagaacaacaaccttatttttcataatgattactccttaaaatatcaaagttggttaaacgttttactaaattaagggttgatcacagtgtacgttattttaaaaataatgtcaagaaaaaaagcaaccataatgtcttaatggttgtcttttgtatttttaactggcccggtcgattcacggataaccaatttaacatcgaaaaattcagtttgcaaggggaggttaggatgatcgagacgtcggataatcatttttaaagccgtttcaccaatttcccaaacaggttgtgctatggtagttaatgtaggaatcataaattctgcataatctgtatcatcataaccaatgatggaaatatcatcagggactttaatatcttgataggccaaaccacgcaaaacaccgatagccatttcatcattcaaaatgaatgctgctgtagatttactttgaataagttgatgaacagctgccaaaccgccatgttttgacaaagtagtagtaatgattgcttttggcgttaaatttgctgtagataatgtgtctaagaaaccagctcgacgttgccgcatgttatcggtcagattatttggtaaaattaaagcgatatctcgatgaccaagtgacattaaatgactggctgccatacttccgcctgtaaattcatttgtttgaaccatatcatgtgcatttatatcggcattttgatcaagcaccagatacggtatattacgtttttttaaaaacgtattaacttccgctcgattagggatgtgccggccaaaaactaatgcttctacgccacgctcaaccaaggaaaaaattgcatcttgtaaactttcatcggttgaccctagaaatactaaattaacatcagatggcgcactagcttgcatgctttgaataatatcggcaaaaaaaggcatgcggaaagaagggactatgatgccaatcaagcgtttgtgcctgcccttaagatttcttgcagcgctgttaggaacatagcctaactcatctcgtgcttgaagtactttttcaatcgttgcctcagaaaaacgttggcctttgttatttaaaatttgagatacagcagcaatggaaacgcccgcttttttggcaacatcttttattgagattttgcgcatcacattttactccttagtttaaaaacattgttcttaaactattgtaccagtaaaaaataattgaaaacgcttccattttcaaaaagttggtgttataatgtttttggttaaacgttttactaacttgcattttgttcaagagaggaataacttatgtttttatttgctaatattcttggtatttttgttttcattgccattgcagctctgttttcaagagatcgaaaaaatattcagtggaaatcggtcggcattgtgctggcactggagattttgctagcctggttttttactcaattcaaggccggacaaatcgctgtgcaagctgcagctgatggtttcaattggcttgtttctgtggcaacacaaggaattgcatttgcgttacctgaatggttgacttccaataatggcgggccaaactttgtgacttctgctttgttgccaattttattggttgtgcccttgtttgatattttaacctatattggtttactaccatggctcattaagtggattggtaaggggctcgcttttataactggacaaccaaaatttgaagcattcttttcgattgaaatgatgtttctaggaaatacagaggtcttagctgtttcaaaagcacaactagatatgatgtctgcgcgaagaaactttacgctcgctatgatgtcgatgagctgtgtcacatcggccattattggttcgtatactcaaatggttcctggtaagtatgttttaaccgccatcccgcttaatatattaggtgctattatcatcgctacgattttaaatcccactaaagtgacgcctgaagaagatgtcatcgtcagtgttgcatcagataatggtaaaaaggagcctttcttttcattcttaggcgattcaattcttggtgctggaaagttgattttaattattacggctactgttattgcgtttgtttctttggcggcactgatcaatcagttgttcagtttaactgggctacactggttaacattagaaaatatctttggcgtaatcatgttcccatttgcatggttactgggattcaatgttcaagaggctttccaaattgcgcaatacatgggcacaaaattggtaactaatgagtttgttgtcatgggtgaagtttcaaaatcaattatggccggtaagggactctttgcaaatgaacatgcacgtattgttttgacggttttccttactagttttgctaactttggaaccctgggcatgattattggttgtttcaaaggccttgtcagcaaagaaaaaaatgattacattagtgcacgagtaccatacatgttgttgtcagggatattagtttcattattgtcagctgcaacagcaggaatgttcgtttggtaatcaaaagagaagttcttaaaaggagaaatgatgatacctataattttagacatggatccaggaattgatgatgcagttgctctatcgattgccctcagcaattctagcattgatatcaagctactaacaagtgttgctggaaatgttagtgttgacaaaacaaccaataatttattaaagttgacaacattttttcatcaaacgcagattccggttgcaaaaggtgccgctgcaccattgaaaaaagatttctctgatgctgcttatattcatggcgaatcgggtatgcctggatatgattttcctcaagtgacaaaagaagcaattaaattagatgcagttactgcaatggccgaagaactggaggcatcgatcgtgccaatgactattgttgctactggatcatatacgaatattgcattgctgatccaaaaatatccaagtttacttcacaagattgaaaaatttgttttgatgggtggctctttgtcaggagggaatgtgtcttcagttgcagaatttaacgtgtttactgatccagatgcagccgacattgttttcaaaagtggtgtgccaattgttatgattggccttgatgtaacgctcaaggcgctattaccttttgaaacaatagatgctattggtagtcaaggggaagcaggtgaaatgttacagaaagttatgacagcttatggtgatactgcagaaggtggtaagcctatgcatgatgtcaatacaatttgttatctattaaatcctgaattttatacagtaaaagattactgggttgatattattgtttctggaccggctgcgggcgccacgattgccgacacgcaaaatcgatggtcagaaggtcgattgaatgcacaggtggcggttgatattgacacaacagcgtttgaaaagtggtttgttgaacaagtaccgaaaatgaatcaatatcgtaaagaggaaaattaaaatggcatcaacaaaaatgattttggacttggatactggtgttgatgatgcgctagctttggctttagctgtgtgtgatccacgagtggatttaattggtgtgattgcttcttacggtaacacactaatgaaaactgcagcacaaaatacattagatttattacatttgttacatgctgacgaagtacctgtatacttaggcgaatcacaggcttccacagttaatgattttgaggtaatgcctatatcgaaagctattcatggtgacaatggtgtaggaaatattttattagaaaaatcgccgcgatcaattgaaaaagaaagtggcattcagttcttaataaatatggctcatcaataccaagatgaattagtatatgtacccactggaccattgacgaatttagccaaagcattacaaattgatccaaagattgcacaattgattgggaatactacattaatgggtggtgctttaacggttcctggcaatgttacaccatttacagaggcaaatattaaccaggacccgcaggccgcagatcaagtatttactgctcaagaacacttgacaatggtaggtttagacgtgacccttcgtacgctactgacaaaggcacacacaaaaaagtggcgtgacttaggaactaaagctggtcaaacatatgctgatttgatggactattatattgatgcttatgataatttaggtattgatcacaggggagcggccttacatgatcctttagccgttgcggtagcgatagatctaagttatgttatgacaatttcattaaatatgcgcgtgactcatgatcaaaaaacgaaagattatggccgaacgattggcgatcgggagcggctacttgaaccgacaacgacaaaagtggccgttggtgtaaagtctgagcgcttcatacatgacttcatggattttatgattgcagttttaaaaaattaataaagtagaaagatggccattacgataagtaatttgttgtagtggcaatctttttttgtttagttattatataatagtgaggtaattcaatatttatcagagagatagggtgagtgcttgtcatgaaaaacacattgcagaaaaacaacgttaaatccgatcagagtaaacatcagttaatggttttaattggtggaacagttttgattggcattgtcgttggcctcagttctctttttttagggcttttattagagtatgttgaacaattatttttgaactacgaagaaaccgtttggcaaccagctccaaccggaacaattcctgtccgccgattattttcagtgcttatcggtagtatgattgctgccgttatttggtggtttttaagaacaaagacaaaaccaacggtggggattactaaagcattgtcgggagagaagatgcctttttggcaaactatccttcatgtcatgacacaaatattttatgtaggtactggtggttcagtggggcgtgagctcgctcctcgagaagctggcgctatgcttgcccaaaaagtagggtcggtgtttgaaaaatttagcctgcctcagttatctagtgatgatcgtaaattactaattgcatcagccgcaggcgctggttttgcaggaatatacattgcgccaataacaggaatgtttttttgtactgaaattttattaaaaaaaatgacggtacgtacagttgcagtcagcttaagtatgtcaacgattgcaatgcttattgggtcaatcgccaaaggctttaagccatattacttagttggggatgcaaaattgtcagtagccactttgctggtggtgttagtgattgcaccattatgtggtattgctggggcattatttcgaaagttatgccaatgggcagaaaaaaatcaaacccgcaagaataacattctgtggcaattacctatgatgggattgaccacgggactaatttccataatattcccagaagtgatgggcaatggtcggtcgttagcacaattggctatcaacagtgaagggtttctttctgtgagtttattgctattgggtgctttaacaaaaatggtggtgactgtattgactattcgatttggtgctgctggagggaccttgaccccagcaattgccattggggctgttctaggagcatttattggtagttttttactttatttggttccaggtattccaatgtgggaagtagctatactaggtgctgccacgttacttgccgcctcacaacaagcaccgttaatggccttatttatgatatttgaaatttgccatttgaattatgcgatgttattaccacttggtctgggcgttttaatatcaattgttatctcgcgaaaagtattgagtcagttcaactgatttatatatgtttatattaaaaaagactggaggtttttccagtctttttggtacaaagcaaatatcattctaatacatcatgaatggtgaccacaccgacaacttttttatccttatccaaaacgactaagttggaaatattatagttggccatttttctccaagcttcacgatttcttttgtcttcactaatactaatgaagccttgtgtcatataatcttttgctgttgatcctttgactttactgatattaaggaacttttttcgaatatcaccatcagtaataataccaatcacattttcttgttcatctttgactaaggtaatacctattccgtagtcactgatacggtagattacctcattgattgaggtgtcgacatgaacatagggaattttagtgtgcattgaatttttaacgttttgaagcaaaatttttccaatggagccgccaggatggtacatcgcgaagctttcacgatcaaactctttggcagtttcgatggcaacgagcaaggcatctcccatgacaagtgtggctgttgttgagctagttggtgctaactttgtgatatcggcttcttcagcaacatcaattgagagcacaatatctgtattttttgcgagagtcgaatcttcagaacctgtcatggctatagttgacaattcattgttatgaatattttgtagtgctgacagggcttgaagtacttcttgtgtttcaccactgttggatatgaatataacaacgtcatcagatgatacacgtcctaaatcaccatgataagctgtccctgcatcaatatagaaacttgccaagcctactgaagaaaatgaagcagcaattttatcagcgatgataccagattttccaatgccgataaatataacgcgacctttagtagataaaattttatctactgcttcatcaaatgatttacccagcgagcttttgacgcgagtcagtgcttctatctcaacatcaaatgttttctttgcgtcttcataataaaccttcatgatcataaaccgccttcatcttgagattttgatggaagaggtcgttagctacctctaagattggacgtattttagaaaggtataattgactatcctgatcagaaatagcctttggtgggttggggtgtacttctgcaaagataccagcgacaccaatcgttaaggctgcgcgcatcaatgggaatgcataatctctattaccacccgaatggttaccataaccactaggtatttggatagagtgagtagcatcgtagatgataggaaaattagtctcacgcatttgaataagactggtcatatcaactacgagctgatgataaccaaacatactaccacgctcagtaactaaaatatgtttgttggtttcttcgaccttatgcacagcactttgaatatcttctggtgccatgaattgagcttttttaatattgacgacacgaccagttttgccagcggcaattaagaggtcagtttgtcgacttagataggcaggaatctgtaatacatcagcgacctttgcaactggttcacattggtaagattcgtgaacatcagtaacgatagggacattataagtctcttttatctttttcaaaatttcaaggccatgagccattcccgcaccacgatcggaatcaagtgaactacgattggccttatcgaatgatgatttgaaaacaaagttgatgcccaactcgtcagtaatttcttttaacttttcggcaacctcagcacatgtctcatatgattcaattgcgcatggaccagctaacagcgttagcttatcatccgaaaaattgtactcttggaaaacttcactaatttttgtcataatatatctccttatatagatacaaacgatgcacatatcctcgcggtatgtgccacgagcccaagtattgagtgaagaagccttggtaaacttattgtagcatttttgaatttagaagtagtaaaaaatgacttttcaagttttaaggaaacaagcgagagcgactgctactttggaacaaagcagtggactaaataataattatgagagataataattgttaagtaaatttgatgaataatgaaagtgtaatactatgacagatgaagagacacaatacaaaaaagggttggatatcttacagaacagcgaatttcgtgtaacgaaacaacgcaaagatctcctgaaatacttatcaaaatttgaatcacaatacgtctcagtgactgatgttgatagttttatgcaacaactgtatcctaatgttagccatacaacaacttatcgtaatatcaaagaattctctgagctgggcatcgttgaacaacgttctgaaaatggtcagctgaatgtcaaatttcaatgtgactttgtttcgccacaacatggccactttttttgccaaaattgtcatcgggtgataaaaatagattcaagtttgtctcctgcattaaaagactcattgaaagaatttttggtattaaacataaaattagaattgtttggtttgtgtgaccggtgtcagcaaaataacaagagagcatgacattaagttaccttatttataaaaaagagcagctatattgtaaagatatagttgctttttttcttttaaagtaatcattactttttgttgactttaatagtaatgattactataataaaaaagaaatattttaacactaaatataaagagaaggcagttcttatgtttcaaacttaaacaaaacgtttatctcaacataaattttagaatagatgagaaagtaggaaatagaattatgaaacaaaagtatttttttggcagtttgattggcgttattttaacgctcttcatatttgttactggtaacagcacagtgagagctgatacaaaaaatatccaggtagtttcctcagttgatttttatggtgaagcagctgaaaaagtgttgggtcagtatggtacggttaaatcggtcattacgaaccctaatgttgatccacatgattatgaaccaagtgccaaagttgctacagaagtttccaaggctgatttagttgtatacaatggcattggttatgattcttggatgactaagctagcaaaaaatgcaaatgttaaatctgttcgagttggtgaagatattttaggaaagaaaaacggcgataatcctcacttatggtatcaaagccaaaccatgcctaaactcgcaaactacttggctgacaagttttcaaaaatagatcctaaacataaggctgcttttaaagcaaacgctaaaaaatacatcgcgagcttggaacctattcaaacaaaaataaaatcactaaaaaagaattcagataataagttagttgatgtaagtgaaccggtatttgattacgctttggaagaacttggatattctgaaaataatacacatttttctaagtctgttgaagatggtacagacccatcaccaaaagatatcaaggcaatgcaagatgatattaaaaataaaaaaatcagcttctttgttcaaaatacgcaagcaaccgacaaaacagttggacaattagtaaagttagcaaagaaacatgatgtaccagtattaaatgttactgaaacgatgcctaagtgtaaaaactacaaacaatggatgttaagtcagtataagcagttagaaaaaatccaaaaatcagaacagtagtcatcatatgattgagaaaattttagaagttaaacagttggatgttgaagtgccaggaagtctattaattcagcaactttctttttcaacctactcaggggcattattatgcatcaccggcgataacggggttggcaaaacaaccctaattaattatttactaaaggcagcaagagacaaaaatagttatcaatcagaaattcatttgcacattaaatttgatgacattcaattagtaccacaatttagagatattgatgcagagtatccgcttagtgtaaaggattttgtagtgttgaatttgacgcatcctcttacgccttggctaactctttcagaaaagaagcacttagaaaaaattatttctgtaactaatttaaacgagattaagaatcgtgctttaggtcgtgtttcaggtggcgaaaagcagcgtgcctacttagcacaagcattaatggcaaatcccaagatgttgattttagatgagagtacctctaatttggattatgagtcacggattgatcttttgaaactagttaaaaaagttattgcacaagaacagttagctgttattttcattacacatgatccggagctggttagtttgtttggtgattatgaactgcacattagtaatcaccacggtgaaatgaacgaattgccttcttctgcagaaaggggtacgcatgtttaattatccgtttatgcagtatgcgttcatagcaagcttttttatatcaattatttgtgcagttgttggtgttttcgttgtggcacgtaaaacatccttttatgtccatactttatctgaaattagtttttcaggtgcaagttttgctatttttgccggaatatcacccattggcggcatgctattatttacgatactaagttcaatatttgtttctctcgcaggtaaccggttgagtcaacgggaatcttctattagtgttttttcagcaatattcattggattaggcgttttatttttgtcgctgtcgactaagcagtctagttatgctactaacattttatttggtagtattgttggtattagccaagaaaatttatatgagctattagttttaattatcgttattttattaatcacgctattaatgtatcgaaagctcaagtatatatcttttgatacaatcggttctgatttgaatgctaaaggcaccgtctggatttctttactatttttaatactagtggcatgcactgtcagtgtgaccgcgcaaattgttggatcattattgatattttctttgttaacggttcctgcatcctctgccaaatacattgttaggtctgtccatcatatgatattgctttcgtttgtgtttgcattgtttggcacctggatgggattgtatttgagctatattagtaattggcctgtcagcttctttatcactattattgagggtgctatttattgcttatcattgctatattataaaatagacatgttacatcgttaatcattgagcgagtatattgtttgccataaacatttgcctgaactataattgccataactaatataggaagaaccactaaaattggaggaaattttatgacacagcaatacgattatgatgttttatatttgggtagtgggcatgggacgtttgatggtgcagttccacttgctcaatcaggggtcaaagtcggtattatcgaaaaagatttgattggtggtacatgtccaaactatggttgtaatgctaaaattacactcgatgctccagttactttacttcgtgaatcagagcgtttctcgggcgttgttgcgggtaacttgaaaattaactggaaagaaagtgttgcgcacaagcaagaagtgattgacgagttgccagggatgattggtggacttatcaagagttcagggattgatattattcaaggatcaggtgtttttcaagataatcatactattctagtagatggtcagccaaaaacagctgataaaattgtcatttcaactggcttacgtccacataggcttgatattcctggtagtgagttggcccatgatagccgtgagtttatggatttaactgaattacccgacaatattgttattataggatctggctacattagcatggagtttgtaacaattgccaatgctgctggttctgacgttacagtgctgatgcacggggacaaagcgcttaaagaattttatcagccatatgtcaacaaagtaattgatgaccttaaggaacgtggggtaaagtttgttaaaaatgctaaggtttcaagttttgaaaaatcaggtgatcaagttatcgtaaattatggtgatgatcaatcattatcagttggatgggtgttagatgcgactggtcgcatcccaaacaccgacaacctagggttatcaaagattggcgtgaactacaatgaaaaaggtgtgatcgttaacgagtatttgcaaactaatgttgataacatatacgcatcaggtgatgttattgataaaatacagcctaaattgacgccaacagcaatttttgaatcaacttatttgtttaagcgtttttctgggcaaagcagagaacctatcacatatcctgtgattccatcagttgtatttacatctcctagaattgctaaagttggagtaactgttgaagaggcaaaagagaacaattatcaaattgaagagaataatttggttggtgattggtatcgtaaggtgaacaaggaaacaattagtgagaacaccttaatttttgatgatgaacatcgattgcttggtgcaacagaagtcagtgagcaagcagaaaatgtgatcaacacattgctgccagccgttgaatttaagtttaacaaagaagaaattgctcggctaattcacttgttcccttcaatcagcgcctctacttgggatttgttataagctagtggcagcttaaactttctatggtgctgtgatcataaaataaaaaagtataataaaaaacgccaaaaagatattacttatccttctggcgctttttgttttttcttgcaaaactgtttgagttggcaaatgttagtttcccgatactgtacactgtcgttaatagactaatcagcatcgtgaaataattactgatatttactgtaaccgtaatttttaaatggttcagtcccttaggaatttttaatttaagagcatggctgtttgcaagttttacttttttgtgatttaaagtaacattgtaatgaatgcctgagtatacagcaattggtagagaatagtatccttcctttgccgtagtgatcatgtactcagcactattatatgtttgcgattttattttcagggaagaaacacttgcattttgtaaagcagttattctagattgtagttgatgcttattgtttgcgggtaaataatcaattcctattgcgctatttttaatggtttggacatagttgtctctagttagccaaaaccggtaaccatctttcgtggttttgttgtgataagtgtgaaccgcatttaaactgactgcaaccaaagctaaggtaatcacaaaattaatgtctttgtattttaaaggatactgatcaaaataatacataacactaatggctagcaatagggaagaaatgaacaataatcgccccaaaaattgaatcatattgatcggtgtactggtaaggttttgccaaggtaaccagtcaaaagtgctaaaaaatacgataattgttgcaattgtccaatggcgccataaaccagatttatttgtaaacaacataatcattaggaaaaacaataagaaggtgttaattggtcccatgttaaagctagcggaacgttcaatgatactattatcaagaagagcttgccagtattttgttgcatttaacggtactaattttggtgttggactcattaataaattggaggatagcagtgatccgatgttagtgagcgtataaaaagacgataaaatcgctagaacagcggcttttgtgtaattgataacttcttttcgtgttaattgatgacgcaaaattctgataaaacagaaaatagcaatcatgattgttacaatgattagagaaagaatgtgactgttagcgatggcgcccataccgaatcctaagtatagccaaccatttgctaaattatgccatattttgagacatcccagcagtactaggggtaaaaaagcataagccagtgcttccccaagtgcattgcgagaataaaggacagccatatgataagaactaaattggtatattgttacgccgagtatttgaatccatcttttatgtgttataaacttagctagtaggaaaacgttgaaaattgttaaaaagtttaaaatgataaatccaaccattaatgcaactatcggattattaaacaataatttggggattataaaaatagtgctagttatccatggatacataccgttcatggcaagcccagtgtggtgaaggccaataaaatttacaagagggggtaaagaaccatgactaagcgcttgtgttatagcgtcgtagcgtgccaagtgaatattaccatcgtagctcaatttgaatgtgttgttggtaaaagcgggtaacgttgataagagtgatgatacacagataatgacaaaaacaatgaagtgatgcaaccatactggggaatgacgtcttaacatgatatatccttttttagttcgttctaaactgatttatacctaccataataaaaacaaggtcaaatagcaactataaaaagactaaaatgtcattatgtataaatatgtttaaaattaatgttcattttatgttaaaacgatagtatttttctggcgtctaatcttagccaagaaatacataaataggggaagttatgtcaacatttttacaacaggttaaaaaactatggccaatcgccattctactactgtcgtcaatactgcttttaataccattcttcttaaatcatgcaatgattattgggtctgatgctatttttcattttaatcgcttgtatgatacggctatgcagataaaacatgggaactttcaatattttatttccatgtatggattccaatcttctggtcgaattgtcaatgccttgtatggaccatttatggcctacatccaagggctgattgtattaattagtccttcttggtttggttatcaggtgatttcaaatggcattttgtattttttttctggcttgtccttgtatcttcttttaaaaaaagctggtgtacagcttgtatatagaataccattaggtattttttatatgaccacatactctgttcaatattggacattacgacaaggattttcgagttggggagcagcattatttccactctgccttataccgctaattgacttaattgaaaaaaagacgcttcatccaatccaaacggctatatgtatcggcgtcatgtgtcaaatccatatgttatcagcttttttgcttgtgtttgtgtatgcttgctttttcttaacagctttttttgctaacagtaagcacactaaaattaagcttttgaaacagctaggattagccattgttattttcggttttctagtattaaatgtactctatagttttattgctatttacagtgaaaataatattgctcaaccatttgtcaataaatggatggcagaaacaactatttttaaaggtagtagttattggttattttatccgcccatcttaatgattattgtgctgtttgctctatggacgatctgtaagcattggaaaaaagagtcgcaattattgaaagtaacagcggttacctgcggatttttgtttattttatgtacagatctatttccgtggaaattattgaataattcccataatcaattaattgagacaattcaatttccgtttcgttttttcgtacctttcacagttttactactcctagcagttggtttgcttttggaaaagtggcatactagatcagttatttttgggctcatcagctatggtttattactattgtcgttgttgcaaacaggcatttcaactaacaatgccttgaatgtgtggcaccaaaccgaatcctttttaaattcttctgttcatacgtattttacgtctgaaaataccagtgaaatcaagaaatcttttttcataaaaaataaagtacaagctttacaatacgtggtaaagtccacccctgattacttaccggtgaaaacagttaagtgtaaagataaatattcactttatcatcatcaagttattaacaaacaaaaatacttccataagtctgttaaaggcaataagttggtagtcgaatgggaaggcagaagcgttaagaatattcaggttccggttataaagtacacagataccatcttgcgattaaatcaaaaaatgctgcacacaaatgtcaaactcagtcgaataggaacgccaatcgtcaaacaaaggaaaggtcacaatgaattagttgtttcttatcgtagtgatcgtctgttagatacgatactcatatttaattttatcagttggttaattgtattttatatgaattacaagttcaaatttttgaacgagtgatgattaactaagaaaagcctgttcccattaaaggaataggcttttcttattatttggcggcgtattgttccaactcttttaaatataattctttctggtcggtactaatccaagctgattcaaaagaattgcgagctaactgaattagttgctccttacttagattgaaatcagtagccattttatagtaattgtcactgatatatccaccaaaataggctggatcatcagaatgaatggaaattttaacaccttggtttaacaagtcaatcaattctttacccttcatatctggcgtaacaaaagaattagagagggggcaagatgtcaaaccgattccttttttaataacgaagttgactaagtctgggtcttcgacgatgttggtaccgtggtcgagtcgctcgacttccatgatttcaagtgcttggcggatatggtcaatggaatccttctgatcaatatcacaatgagttgttaaatgcaggccgtgggctgcggcatattcaaactgacgagcaaactttaaaggcggattattatgttcatcagaatcaagtcctacaccaataaatttatctttgtaaggaagcgcttctagaagcgtttgccgagctgactctttcggtaaatcacgcaagaaacacataataagtgcagcatcaacatttaaagcacgtgcatctacaatggctctatggaggccagtaatgattgttttaaaggcaatacctcgcgtcgtatgagcttgaggatcaaagaaaatttcgacatgacgaacattattgtcagcagctcgtcgtaaatagtcaaaagctaaatcataaaaatcttcttcagttattaaaactgacattcctggatagtagacagctaaaaaggacgctagatcgttaaattgataagatttttgtatgtcctcgacggttgtttcagttagcgtaatatgattgcgttgtgctaacttaagctttagctctggttcaatggttccttcaatatgcacatgtaactcgcattttggtagtttttttgtgaattcattcgtaatcacagttgtcattgtgttgtactccatttgctgtattgttcttaatttattgatattttttattttaacatactgattgattgaaaatagtcgataaatacttatttattgtttaatttattttttattgttcgtttattggcgataaacgctttaatagtttattatttattaatttgatacaatgcactataggcaactgttatggtgttttgccataattattcgcaaccataaagaagtaggggggatagaatggtatctgttatgtggtttcgcagagatcttagattagaggataatattgcattatttaatgcattgcgacatagtaatgaaattttttgtgtgtttcatatcaatccggaacaagtgacagaaacgagtactgtcaatcagagtgctttttttgcgagtgtcttgtattttaaaaacaaactcaaaaaacaaggtattactttaaacataatgtatggtgatattaatgactgctttgcttctttaaaacagaagttgccagattggcatgacatcttttttaattttgatgaaagaggctttgggagaaatagggatcaaaaaagtgtagctttttttgaggataagttaaaggtgaaagcacatccttatattgattataatctacacggtgccaccgaagtaaaaaaggattcaggggcagggtacaaagtatttaccccttactttaaaaggtggatacgccaagaaaagccagcaccagtaagctatgtgattgataaacgaatcaaaagcgcccgattactttttccagaaaatgagcagctactagaaacatttattgatgatcgtttttcttttataaaaaaagatttaggtagtgagacggccaaaaaggtgctcaatcgattcattaatgaaagtttagatcagtatgatgaggaaagagactttccggcaaacgacagcacaagccatttgtcgcgatatttgcggactggagaaatatcaattcgaacagtttggcgagcaattgatcaatctcctgatagtgatggcaaaagcacgtttatgaaagagctttgctggcgtgacttctacaacatgatttatgtgatgtacccgaaccaaaatgttgaatcgattaataaggattttcgacatgttgattggataaacaatgaacagcaatttgaagcctggcggacaggccaaactggttttccgattgtagacgctgctatgaggcaattaaatgcgactggatggatgcataatcgtttaagaatgattgtcgcttcatttttgactaaagatttactcattgattggcggtggggagaggcttactttcacaataaattgctagattatgatgcggcaagtaatattggcggttggcagtgggctgcttctacgggaacagatagtgttccttattttcgaatatttaatcctactttacaatcaaaaaaatttgattcaaatggattattcattaaaaaatatgtgccagaactaaagaatgtggacaacaaaatgattcatgaaccaggaaaactctcggaatcagaacagacacgatttaatgttagaataggtcagaactatccctttccgattgtggatcattcttacgcaaggaaacgcgcaattagcatttatgagagcagtaaagatgttaattaaacagttagagaggcaggaggcatatcatgtttttggcattaagagaaatcagacatgagaaattacgttatagtttaattgttacgttaatactttttattagctatttagtttttattctaaatggtcttgctacgggattgtctgatttaaacaagtcggcaattacgcaatggcaggcatcaaagatactattagacaaagatgctgaaggacggttgacacagtcatttctggatagtgatgatcaaaagaaggttagtgggcaaggaactgcaattagccagtacagcacactagttaagaacagccatgctgataaaactaacgcacaaattttggcaattaaaagtgatggctttatctataaaaacataaaaattatatctgggcatcgttttactggaaataatacggcgaccgtatctgatgaattaaaaaaatcagggtttaaaattggggatgagattaccatagctaacagtgacgcgaagttgaagattgttggctttacttcgaatgcatccctgaacgtggcaccggttatttatacgtcttttcaaactttaaagaaaattaaccaggctcccgtcaacgcgttagtgtttaataaaaagatcacaggcgacgctcactttaagaatagcaagttgtacacgataaatagttttattgaaaagttaccgggttatcaagcccagcagttaacctttaaatttatgattggttttctttttgtgattgttttgattgttatttcaatcttcttatacatcttgacaattcaaaaattacctaattttggtgttatgaaagcgcagggtatttctactaaatatctggtattaaacaccctcacacaaacatttttaatggcagtggtgggtatcgggctggcaattatttttacaattataacttcttacgttctccctagcgaggtgccaatagccatttcaaccacgcaagtggttgccacaagttttggtattttgattatgtcgttacttggttccttattaccaatcaggcaaatcattaaagtagatccatttgaaatgattggaggttaatactatgtcacgcttagagtttgaaaatgttagtaaaaaatatggcaccggaacaagtgaatttttggctttggataatgttaatttcagtgctgactcccagcaattaatattagttgttggtccttcaggttctgggaaaacaacttttttaacaattgctggtggattacaatctcccacatccggtacggtgaaaattaatgatgaaataatcggcgagttatcgaaaaaagagcagtcagatctccgattaaatacggtagggtttattttgcaatcttataacctagtgccttacttaacggttaatgagcaatttgaactagtagataaagtaaaagaacaacatttatctcatgaagcgtttcgtactgttttaaaaacattagctatcgaggacttgggagaaaagtatcctaacgaactctctggtggtcaaagacaacgtgttgctattgcgcgggccttgtatgctgatccggaatatattttagccgatgaaccaactgcttcattggatacagcccggtccaaagaagttatgtcgctattacgtgaattagcccataagaatgataaaacaattattgttgttacccatgatttacgtttgaaggaagaggtggataaagtttatcaaattattgatggcaaaatgtccaaaattgatgatggtaaattcagtgagatatattaaaaaaacctacgtgaatcacgtaggtttttttattagagaaggaaaatttaagactgataacaccatttgttgaaataagatgtgagcgtcttaggcgactctttcatgtcactttttatccaatgtctgatcataccaacaactccgttcaacgtatactcgtatagaaattgcttttcactcattgatagtgtgtcgtcgtctggaacaagctggttaaaaaacttctgttttgtggtagataaaatatttgctaaaaagtcttgatcttcagtcaaaataaaattgaaaactttattattttttttaactagttcaaatatggcttgcaataaaacttctacagaatcagtttgtttatcattctcaagtatagaaaaaagttcattagcagtttctttttccatatgattcatgcaatcagcaacatcaacaaaatgagcataaaatgtcccacgattaatatcagcagttttacaaatatctgtcacagatatactgttgatatttttatcgctcattaggtgtattagagcatcttgtatgttttttttcgttaactgtgcacgtctattatttttggtaccaaccattttatttctccgattcattagtaagaaataccatcaatatattatagcaataaataataaccagttgatatgaaattaagatatgatataatattttccgtacactatgttgttttaataacatcatgtacgaaaaatacactggaggatactagagtgaagggtagcaaaaaaacttttctcgtacaagctgtcatttggttaattattatgatttcggcagtcatatggttaccaaacacaagccagttgatcaaagaaaagggtgatacaagtttaccaagtgctgtcaaaagcgaggtagcgcagaaaattcaagacaattggggcaagggtcaagataatacgcggcaagtaatcgttgttttcaataatggtaatgaaaaaataactgctagtcagggaaaaaacattgcgaaaacaattgatcacctgaagaagaataaatctacctatcatatcaagtcaattttagcgccagaagatagttctgaagctaaagcgcaattgctttccaaagataagacaacagaattagttcagttaaccgtggataaaaagcaatctgtcagtcaaatgacacaaactttaaccaaacaagctaaaactgatggtgttaaaacctacataacaggtagtgacattcttgaagatgacttctctgaagaaattgaaaagggattacataaaacagaatggataacggttgtatttattttcttagtgttaatggttgtctttagatcagttatcacgccggttgtatcactattctctgtgggggttgcatttattacctcactgagcgttgttatgaatttggtggataagtttaattttcccctttcaaacttcacgcaggtatttatggttgttgttttgttcggaatagggactgattataatatacttttatttgatcagtttaaggaagaactgaatgcaggatatgaaaaagtagaagcgaccaaacgtgctttgaaaacggctggcagaacaattttgtacagcggcatttctgtgctgattggttttgctacgctggagctggcaaagttttcaatttataagtcagcagtaggcgtttcaatagcggttgctgtattgttgcttgtactattaaccttgaacccattctttatggctgtatttggtaaatacttgttttggccaagtaaacggtttggtgagacttccgaaagcaagttatggcaaggcatagctaaaaagtccatcaagtatcctttgattgctttattgactgtgattttaatggctataccgctctttgtcagttacaatagtcaattaaactatgacacattaacagagttaggtgaggatattcctgctaaaaaaggatttaaagtagttcaaaaacatttttcagcaggaactgcagaaccttcgacactatatataaagtcaaagaataggttagacaatgaagcaagtcttcagactattgatagtttggcagacaaactaaaaaagaccaaaggtgttaagacggttacgtcagccacacgtcctggtggctccaaaataaaagagttatatgtgcgtaatcaattgggtagtgttactgatggtttgaaaagtgcaatttctggtacaaagactattggtaatggtttgagtgatgcaagtaatcagctatcaactagtaatattaacgagggggttgatggggccaagcaattagcagatggttccgcagaactaaagagtggtagtgcacaactaagctcaggtgcaaatgatttgaataccggtataggtacgctatcttctggcacgtccgggttggctgaggggttggcaactttggatagtaataaggcggtcattcaatcaggagttggtacactgaatactggtgtaagtagtttaaacagtggttctgcacaaattacagatggactaaagcaattagaatcagaactgagtgcacaatctggcaataatgtagcgggtcaacagagtcagattaatgaattgaaggaaagcttacaaagtttgaatgaatccatggcatcattatctaaaagctcagacaatagtgatagtctatccaaacttaacaatacttctagtctgctaacgacatctagtgctaacatacaggcagatgcaagtgatttgaaaagttcattaaatacagctttgaatagtaatagttcactcaatgtgctttctgaaaatgatattaataatattattagtagcattaatagtaagtcagcattaagtaatgagcagcaagctgcattaagatcagcattacaagaacaatcaaaatccatcaatgcacaaatcagttcagcacaaagtactaacaaaaataatattgctgcagcaagtacagctgcgcaaaaattagaaaatgatatgtctacttttcaacaaacaggcaatgcacttactgaagaattaagtaatttgaaggcttttgctgaacaaatgtctaacttaggtgctttagcaaccagctcaattaaagccaatactgcttcaattgcggcattagataagctcagtgaagctatttctggtacacagcaaatgctgacggcattacggggaacaaatggtcaagctggattagtaaatggttcacaacaattaacagaaggattgtcacaattaaataccggtgtatcagatatgcagagtcaaatgcatacatatacaaatggtgtttctagtgcttcttctggtgcaacggcagttaataatggtgttgcagaaatcaagtcgggtagtcagcgtttagctgataatcaaagccaattaacttctggtattgatgcacttaatagtggtcaacaaacgatgtataattcactgaaaggtagggttggacaagttcaatcactacaagagggattaaaagaggcgagccaaggatcaacccaaatcagcggtggtttagaatcagcaaatgattatttgattggcttgaaagaatcttcagcagctaatacttactatgtaccgaaaaatgtattgcatggaaaaacatataaaacggctttagatgcatacatgtctgaaaataagaaagcaaccagcttgaatattgttctagatagtaacccgaattctgaaaaagcaatgaagaaggtttctcagttacaaagtcaagttgagggcgccttgaaaggaacaggattagctaacgcaattgctgcaattggtgggcaaacttcgagaacaaatgatacaagaacaattgcttcggcagacttcattagaacaggcattataatggtcgttggtatactgattgcgttaatctttattaccaaatccttcttacaaccgttatatattatgggaactttgctggtatcttatgtcatggcattgagccttactcagattacaagtcatatctttctcaagcaagatatgctttcttggacgacaccgtttttcgcatttattatgttattagcattaggcgttgattatagtattttcttaatgatgaagtatcgtgatctacaaaaagaaataccatcagctagagatagaattctcagggctacgggaataattggtgtcgttgtattgtccgccgcactcattttaggtggtactttcgccgccttgataccttctggtgtattaactttgattcaggtggcaattacagtaatctttggattaataatattaattatcgtattaccaattgtgataccaagtatgatttctttgacatatcctattaaaagtatgaaacgtcattgatggcttactgaattgttacaaaaggatagttgtgtgtaaagcacagcttttttgttaaaataaattgtaagcgcttgcaattcgacggaaggtgttgtatactttagacatagattagaagaagtcctgtagcaacgcagttgctagacttatttcacgtaagtggtataaatggatttcggctaatccaggagacaacttgctcgttgtttatattatgaagttaagtgaatgctacgtgcatgatgttaattgattagtttaagcagaataataattatttggccaagtgaaagccttggggaatattgttagagagtgggttgttttttattgtttaaagtattcttacgcttaaggcagcgttaagattggccaccttatgtttattggaaaggaaatgctcatgattaatacaattgttgttgcgactgatggtagtgaggcagctatgagagctgtggagtacagcacccagttagctaaaaaatttaatgcaaagatagaaattgttagtgtcattcaatactctactgttgcctatcatgatggtagccagattttttacgcctcgatgacagatagcttaacaaagttagcatcagataatctttccaaagcagcatctgttgttgaacctgctggtgtaccatttaacacacatatctttaaaggggatgctcgtttcgttttggttaacgaggtcatagaaaattataatccagacctgattgtaatgggaaaaacaggtacaactgtcttgacacgaatgtttattggttctactgcacgttatgtatctgaacgtgcggatacaaatgtcttgcttgtaaaataattgtagtttataaaaaacatctaattatgcaaattaggtgtttttttgatgtttaaactcgcagaaatttaactatttatgatgatgcatccagaacaaatagccgcccataataactagtattgctgtaagtagcgtataaataaggatgtaaatatatctgatgtgtgacacaatgtaatttaaaaaatgggccatattttatctcgcttattagtatttttattgtaagtctatgatgcttgatatgtacgcccaataaagggtatttaattatacttcagcacgtaaaactaaatggttttcaacacagccgaatggttgttttttataaaactttttgagctaataatttttgtacatctgttaatgcttgcccttttttaaattgtattttttctgatggctctgtttgcccagatatccagatttttacttctccatcgagatcaaagtgaccactagtttcggtagaaaaccttgcaatagagcggtaggcgatagatttatactcaacttttttacctgtaaatccttgaatatcacttaaaataagcctcttgtttgtaaaaataaccaagtcacgtacaagtcggaatgcgttttcgactatttctgattcaattaaaagaggctcaatctctttttggacacttgcaacaggaacgcttgaagcattaccaattaatccatttaataaattcatattcattcctctcatccattcgtatttgaatagttactcaatactttcattctatcaatagaaaaataaaaagcaaaagaactgcataagatattaaaaaactagttatcatatcaacgtttatgagtattttattccaaaattatatcaaaagattagaaaaataagagtataattataaaaagttttaattttttccgttttgtgttcaatatatggtcagcttaaattaagatgaaatgtgggtaaaaaagaatgaaacaatcaaaacttcgtgagcaaatggtgaaaaacgcgccgctctgggatgagtctctcgagcacgatgcctgcggtatgggatttattgcgcaacgttatgggcagttttctcatgaacttgttgaacgcgccattacactattaacacgaatgaatcatcgaggtggcacaggatcagagccagatacaggggacggtgcaggtctattgatgtcaattcctgacaaattttttagaaaagtagcaagaatagaggggattactttaccacaatcaggtgaatatgctgtggcaatgctttttttgccgtttgatactgtggctaagaataaggttttagataaaataattactgaaatcagtgcagatggttttgagtacatttttgatcgagatgtaccgtttgattttgatgcttgtggtcctactgcgcaacaggctatgcctggatttcgacagatatttattaagaaaccgcagcatgttgctctaggaagggattttgatgacgcgttgtatatactacgccgtcatttagaagatacgatttcagacgaagatatgtatattgtttcgttatcggctaaaacgattacctataaggggatgcttcatgcttaccaagttgggtagttctttttggatttacacgatgaagatgttgaggccaaaatagcgctaactcattcacgtttttcaactaatactttcccgtcttgggaccgtgcacagccatttcgttttttggcacataatggtgagattaatactttgcaaggtgacgttaattggatgaaaacgcatggggttgcgatttataatgaagaaaattccgactcagccatgatggaaaatacaatggaacacttgtatcgacatggtcgctcaataccgcaagcactattaatgctggtgccagaagcacattcaaaagaagcgaatgtgtcagatgagttggctgcctttacagaatataatgaatcatttatggcaccttgggacggtccagccgctgttgtttttactgatggaaacattgtcggtgcaagattggatcgtaatgggttacgaccttcacgttatttggtgacggacgacgggtatgttattttatcttctgaatctggggtggttgatgtgcccgctaattcaattatcgaaaaaggagtgcttggaccggcaaacatgattcttgtagatacgacgacgggaacctttacaaggaatgaggaattgaagcatcattttgcgacgcaatatccttatcgacaatggctcgatgaataccaagaaacattgcaagccctaccaaatcaaaatttattagaacaacgtttaaatgataaagaacggctgactctttttaaacgcttcggatatacccaagaagtgattgatggtgcagttttgaaaatggctaatactgggcaagaaccaacggttgccatgggttatgactcaccattggcaatcttatcagacaggccacaaggattatttactttttttaaacaacaatttgcgcaagtgaccaacccgccaattgatgcacttcgtgagcatttagtcattgcaacacaaatgtatttaggtagagaagttgattttcaacgagatttaccagaaaatgctagcaagttaaaaattgactcaccaattctttcaccggctgattttgctaaaattgcacatatttccaattctaaacaaaaggttgcgcttatcaagctggcttataacttaaccggactagcaaatgggcgattggagcgtgctctaattggaattaatcagcaagccgatgcagcgattgcttctggcgcaacaattttgattctatctgatcgtgaggtaaccaaaaatcaactgactgtaccggctcttctagctgtgtcctcactaaaaaattatttggcggccaacggaaacgccacaaatgcttccattgtattaaacactgcggaagccattgaaacccatcattttgcaacgttggttgggtacggtgcagccgcgatatatccgcgtggtgcttacagaattttagaagcatacgatatgaatgatgcagcacatcaagaaaactatcgtgtagctgctgaaaaaggtatcgttaagattatggtcaaaatgggtatttctacgattcaaggctattatggagcgcaattattcgaagcgattggcttatcaaaaaatgtagttgatacctactttactggtacacattcacgaattggtggtttagacttaaatcaaattgaggaagaatacttaaaacgctatacagcagcgtatgacgaatctcaagacgacccaattccttcaggtggtgcttattcactacgagaagatggtgaataccatctatacaatcaaatgatgatgtataaatttcaaacggcggttcggactggaaatgaagaactcttcaaggagtatgtggctgacattcatgaagcggagcatgaacatcctggcactatccggtcaatgtgggagattgtgcctaatcgtcaacccattgacattcatgaagtagagcgtattgaaaatatagtgaagcgatttaaggttggtgccatgtcatttggtgcattatcccaagaggctcatgaaacgatagctgaggcaatgaaccgattaggcgctaagtcaaattctggtgaaggtggtgagaataggaaacgttttcacacaattaaaaattctaaaattaagcaggttgcttcctcacgttttggtgttaacgcagaatacttgatgtcagccgaagaaattcaaatcaaaatggcgcaaggggccaagcctggcgaaggtggacaactagctggaaataaagtgtttccatggattgccgaaacacgtggttcaacaccaggggtacgcttaatttctccgccaccacatcacgatatctactcgattgaggatttaaagcagttaatatttgacttgaaagcggttaacccatatgccaaaatcaatgttaaattagtttcctcaacaggtgttggtacgattgcaactggtgcggtgaaagctggtgctgatacggtgaccgtttctggatatgatggtggcacaggggcggcgccacgaaattcgattcgtgatgctggattaccatgggaattagggttagctgaaacacaccaaattttatccgctaataaattacgtcagcgaatgactctagaaactgatggcaaactgttgactggtagagatatagctattgccgctatgcttggtgcggaagagttttcatttgcaaccttatcaatggtggctataggctgcattatgatgcgtgtttgccatttaaatacttgtccagtgggcattacttctcaaaatccattattgcgttcacgtttccaggggaaaccggaagatatcataaatatgatgacttttttggcacaagatttacgcgagttaatggctgaattagggttccgcaccttggaagaaatggtcggacatacagaactgttgaaaactcgctttacaacgaacaaaaagtataagtcacttgatttttcgaacatgattggtcaagttattccaatagcacgaaaaacaaaagacccattcattgctaagcgacaatggccagaattagatatggctgccaaagcagccattgataacacacaaacattaacgatgtctgcaccaattgataatgtatcacgtgctgttggcgctcggatgggtggttggatagcagagcgttatggaaataccaaattatcaccaggactccttagatatacgtatactggctctgcagggcagtcttttgcagcctatacgacacaaggaatggagcttaaggtcattggagaagccaatgattatgttggtaagtcattatcaggtgcgcgtttaattgtaacgccaccaaaagatgcaggatacgatacgaataattcaccaattatcggtaatgttgcttgttttggtggatttgctggtgaggcatatttccatggccgcgcgggtgagcgattctttgttcgcaactctggcgtttgtggtgttgttgaaggcgttggggatcacggttgcgaatatatgacgggtggcgttgctgtcattctgggtaaaattggtcgtaattttgctgctggtatgtcgggtggtattgcttatatttatgatccagatcatcaagtggctgctaatattaatctggaaatggttgatctttttgagataaatcaaacacatggagacgacgtattgtatagtttacttcaatcacatgcagcgtacactgactcacaaaaagctaaagatattttagcgcattttgaggatgaaaaggctaattttattaaagtatatccaaccgaatatcatcaggttttaaacattatgaataaatatgaaaccgaaggatttagtggattgactaaggaactcaaggcttttaatgaactgatgccagaatatgaacgagtaccagaaactgaagaagaattagaaacattattatcgaaatgaggtaattataatggctgatccatttggctttctcaaatatgaacgtgttgataatccttatcgtaaaattactgaacgtattaaggatttcaattacatggcagaaccactagcgtttgatcaacgagtcgaacaagctgctcgatgtatgaactgtggtgttccttattgtcatattggtgcgttgtacggcaataaaagtaaacaaatgagtggttgtccaaatgacaatctaattccggaatggaatgacctcttgtatcgaaaagagctccatcaagcttggttaagattggcaaaaacaaatccaattcctgagtttactggaaaagtttgtcctgcgccatgcgaagtgtcgtgtaatgagtttttgaatggtgcaggtgtgacaatcaaagacaatgaagattttattgttgaatatgcttttgcgcatggctgggtagttccagaaggattaccagaacagcgaactggtaaaaaaattgcagtcatcggctccgggccagcagggattacagcagcttggcgcttaaatcaattgggccatgaggtcactatttttgaaaaagatgaacgtttaggtggccttttaatgtatggcattccaaacatgaaattagaaaagtgggttgttgatcgtcgttttaaagtcatgtcagaagtcggtatcaaatttaaagttaatacaacgattggagaggatattactaaggaacaattagacgctgattttgataaagtcattgttgctactggcgcatcggttgcacgagatgtagatgtacccggacgtgatttgaaaggaattgattttgcactaccatttctaagccagacaaccaaaaatgtattaaaaaacggtacgactacatttgaaaaaacattatctaatcagcaggtgattgtgattggttctggtgacacggcgacagattgtattgcaacagcgattcggctaggtgcagaaaatgtaacacagtttgattatcatactgaaaagccgacagatcgtacgacaccttggccggaatatccatggcaaaagcgaattagttatgggcaggcggaagccatggacacagttaaccaggaattaataccttatcaaacgcaaacagtagaatttttaggtaattcatttggagaagtaactggcgttcgaactgttttgattgatgccaataagcaagtgatttcgaattcggaaaaagactattctgctgatttggtattggttgcagtaggatttacaggtctcaatacgaaaatattaaatgatttggatattactcgcctgaatgtcatggggacaacaaaccaagagaattatatggtagcgggtgatgctaatactggtgctaatttggttatcactgctattcatgacgctcgtttagtggccgagttggttgatgcaaaacttcaaagttttgctgatcgtttttcagttaaagtaaattagctaacgaattaaaaatatttttcttgtaagcattattttgatagaataatgcttttttgaatgttctttatatcattttaaatacatgttgcatctaaaatctattgacaggttaagtgaattactgtaaagtgattaactaaggtaattactttagttaatcaaatgcgcagaaagaggtatcgaatcctaattcaattatataagattcaattttaaaatagtcagcaattgtgtagaagtgcataggcagttcgcgaagcgagaaaacaattaaattaatacggaaaaatattatgactcaaaaaaagattgagcaacgtgcatttatggtcggacttgcgatgaatttgctgatgggcagtttgggaattgttgtttattatattacccagattcaagcgttgttcgtagatagttactttacaataatgacactggtttctggaatcgctgcaattacgatttcaaagtatagtgccagaacaagtgagcgttttccaaatggtcacttcaagtttgaaccaatgtatgctgcttttaaatcaatgatgacactgattttgttaacgacctccactattcaagtaagtcaaaaagcatatcaatatttcgtttaccataaaggggatgtattaaacttaacgccgataattccatatgaaatcattatggtcatattatgtttaacgatatctttgttttatagtcggcaaaatcaaaaaattggtcgtgctagtacgatgctatctgcagaatccaaaagtacgcgaattgattcaatcatgtgtggggggattgggttagcagcctttttagttttattgattccaaaaaattcaatcctagggttcttgctatacacgggtgatttctttgtgacggtaatactagtcttattttcaattgcaacgccggttaaagtactaaaaaatgcattcattgaaatctgtggcggccggttaattgatgaaaacattcagaatgaatttgaagcatgccttagaaaacactttggaaaagaagtcatattaactggctgtcatatttataaaacgggcatgtatttttcagttaaagtgatgattgatgttgtcgatgacgaaattgggacaggattgttacgtgataaaaaagtccgtattttagaagaacttaaagcatgttatgagtttgtacatttagagtttgtgtatgcttaaaagaaaaaggggaaatcaaatgaaaatcaatgtttataacgaatatgatccattaaaagaagtcattattggggatgcaacaaagctatattttccagatacgcatgaaatagagcaggaagaacatactgcaaaatggaaacaatttatgacaaaacatatttatactcttttacgaggtaaaaaagttccgagtttccttgctaaaaaatttcaacgagaattagcagaattccaacgaattttggaaacacatggtgtcaaggtacaccatgttgattcggtaaccccaacaaatctagatccctatggaatggggcaaatgtatgcaagagatagtgctatgagcgttggagaacattttattgaaggaaatgttcaaattgaaatgcgaaaaattgaacgacgtgggtatcaaagaattgttgcagctattaacgataagaatcaggtgcacacgttaaatcaaaaggataaaatatatctggagggtggtgacgttatcgttaactatccttatgtattcgtcggcattggtaaatatgctagtaatgaagctggtgcaaaatggctacaaagtattttagacaaggactatgagaatgaaatcgtcgataaaccgtggaaagtagtaccagtgtatttgaatgatgatgcaattttgcacttggattgttgtatgaccattattggtccaaaaactgctattatccataaacctgtcttaaaagacttaccgaaagaactggtcgattataaatttattgatattgatgcaaaaaccagaaaagagatgggtgggaatgttttagttattgggcctaaaaaagttattgtgcaaaaaagacatacagcgttgcaagaggctttaaaaaatgaaggttatacggtcatccctatcgtgtttacatggcattcactattagacggtgcactaagatgtgcatcatgcccgttagtgagagaaaaaaatgagtaaaaagggcgtttagggcgactttttacttttttgctgtctacagaataagaattaaaaagcgtaaaaaatatttttgattgacattgtagaattctaatgataaattagttttgttaaataatttaatcttcggggcagggtgtaattcccgaccgacggtgatggtgaataacctcagtccgtgacccgcgatattttcgcggttgacacagtgaaattctgtgaccgacagttaaagtctggatgggagaagatttgaaatagtttagacgatgcttttttagattgtctaggttttttgaattaatctaaactactataaacccgatgtgtatttttaacgcatcgggttttttgtcctgaaaaattcaggaggtaagtatgaatgatttaacatggatgaagctcgctgcagatgaggcaattcgagcaatgccgtatcaaacttttgaaaatcctagggttggtgcagtaattgttaaagatggtcaggttatcgcgacaggatatcatgaaaagtttggtgaagcgcatgctgaaataaatgcttttaatcgtgtcaaaaaaaagaccgacattttaggtgctacgctttatgtcactttggagccgtgttccacgcagggaaaagtaggctcttgtgcagttcaaattcaaaattggggactgaagcgtgtggttgttggtagcattgatccgaatccgtcaacaaatgaaaaaggaattaaaatgctaagatcagctggtatcgctgtcgatgttttgaatacagttgaaaataaagagatcaaccctgcatttcattatttttataccacacgactaccatatgttcagttgaaacttgccatgtctcaaaacggatttgttgctgaaaaatttggaaaacgaaaaaaactgactgatgagctagctgatgctgatgtacaccgagagcgtgcaactagaagtgcaataatgattggcagcgagaccatgatcacagatcaaccaatgttaactgtacggcacatcaatatcagtcataaacaaccattgagagttgttattgatcgtcgtggacggttgcaaaatacgaactttgatttttcaaataattggctgatatatacggaaaatgttctattttcaaaacagcattcttatgtcaaattaatgtctggtgcgcttaaagatatattaatagatttagccaaacaaaatattcaatctgtgatggttgaaggcggaccaagtttgattcactcatttttgaaagaaaacttgtggcaagaaatgctaatttatacaacagataaagtattatctaaagatagtctgaaaggaatatctgttagccaaaagcctaaaaatgaagtgcaagttggcaatgctgtcaaaaaagtctatatcaatcatcaagggggaacgcaataatgtttacaggtattacacaagaagttggtcgtttaataagcatttatcagcgtaatgacaaagaaatgcgcttaaaaattgctgcatccgaggactatttttctgatagcagagtaggcgatagcattatggttgatggcgtttgtttaacaattaatcagctagaatcaaattatgctgaattcgatattatggtaccgacttttgaaacgaccattgttaaattctatcaagttgggcaaaaagtaaacttggagaaagcacttttagtttccaaccgatttgatggtcactttgttctaggtcatgtagatcagacagctgaagtagtcaaaaaagagtacagtgaagaaaccacattgttaacttttaaattagcagaccgtcaacaaataaatcaaatcgtcaataaaggttcagttactatttcaggtgtgagcctaaccattgttcaagcgagagaagatgtatttcaagttggtctaataccacttacattaaccaagacaactttgggattattgcacgaacgagatttggtaaatgttgaaaccgatattttggcgaaatatttaatgaaaggaaagtaataatgacaagtactacagaaaaagttaaaacagcagttaaagagttgaaaaagggtaagctgattattttgagcgatgacaaaaaaagagaacatgaaggagatttggtcggtttagcatcatttgtgacggcagctacggtcaatgaagccctttcaattgcaaggggtgttctagctgtaccaatcactaaatctcgtgctgatgaactcgggttagaccaaatgacgacgcataattctgaaaaatttgggacaaagttcactgtgagcgttgatcatattgacagcacgacgggtgtttctgcgtatgaacgtgctgccacaatcaaaaatttagctaatctaagtacaacatctgttgactttgagacgcctggtcatattttcccattagtcgctgaagatggtggcgtactgacaagacagggacatacagaaggggctgttgagttagctaaaatagctggtgtgccgcctgtggcgtatataatagaaattttggcacaagacggaacaatggctcgagaaaaagaacttaaagaattagcgaaaaaacacgatatatttcaattatcaatgcaggatctaattaattaccgagaagaccaaaaacaagcaggtattgacgagggaccaacggtatatttaccaactcaatacggtgattttcatttgacggagtttagcgtgaatgatgaagaaaaatctgatttgcttattcaaagcagtcgtagttttgatcaaattcccttagttcgcttacactccgagtgtttaaccggcgaaatatttggttcacaacgttgtgaatgcggtcctcaactgagagaagcgctcaaaacaataaataagcaaggtggggctcttgtttatcttcgtcaagaaggtcgtggtattggactccatgaaaaactaaaaagttatgtgttgcaagaaaataagtttgatacgtatgatgcgaatgttcacttagggcatttgccggatgaacgggactataaaaaggctgccaaaattttgaaaatatcaggattaaccaaaattcgcttattaacgaataatccggataaagtacagtcgttaattgacgaaggtattgaggttattgaacaggtacccttaattacgggcattaatgataagaatgaacaatatatgcaaacaaaaaaggaaaaatttaatcacaagctgtgattgacattaagaaggtaaataaaaatgatttataaagctaagttaattgatcaaacaaataaaaaaattgcaattgtggccagcaagtttaatgatttaattgttaaacaacttatttctggcgcgcaagaatctctagaaatgcatggtattgatgagagtaatattgatattatttgggtaccaggagctttggaaattccaatggttgcgaaaagaatagcgcaggttcaaaaatatgatggtattgtaacactaggtgctgtaataaaaggagacacagatcattatgaccttgttattaatggtgttgctaacggcatttctcaaataagtttaagtacagatgtaccaattgtttttggggtgttgactacagatactttagagcaagcacagcaacggtcaggtgccaaatcaggaaacaaaggggccgaagttgcactcagtttgttggagcttattaatatctttgagcaaataaaatccatttgataagcgtttctcatattgcggatattgttttcattttctattcttttttgtttacttataatacagcgtttgttcagttatgttacaatagaagtatcatactaattagataagaataatcatttttattcttcttttatcatattctcatatatcatgagagaataaattttgacagcgaagagcgtaactgagttacgtagagacatacaatgactaatttaagatggaaatgattcatttttatctataaagcgcaatgatcaatcaagtgagtgttagggacttcgcttgaattgatcattattgttgcgcttgttcttgaatagtatgcaactgccaacatgaacacgctgggaaaaacgtgtcgtggccacattttatcatgtggttttataatctttccataagcagtaaacaaaaaggaggacactaaatggaagcattccgaagaggtgttaaggaaacaatcgcatcgcatcacgttaatatggggaaaggcttagatgctgagcaagtttctaaaaatcgtgaagaatatggtgccaacgtttttgtagctgaaaaaaaagtttcattattgaaaaaaatcttaatcagcctaaatgatgttgctacaattatcttgctaattgcggcagttatttcgtttgttgctacatacttagaagatactgggaactattttgaaagtctcttaattattggtattgtcgttattaattcggtcttatcaattgttcaggaaggaaaagctgaagattcattagcagccttgcaaaatctcaatcgaacgcaagttaaagttttacgtgatggacagatagaacagattgatgcggatgatgttgtgcttggtgatgtattggttgtcgaaaatggtagcgcaatcgccgctgatgcccggttaattgaggctattgagcttcaagctgaagagtctgctttaacaggtgaaagtttgccggttgaaaagaatgcagatgctacgtttaaaccagacgatgaagttggtcttggagaacgaattacgatggtatatcgtgggacgacgattgttaacggtcatggacgagcaattgttacagccgttggtatgcagactgaaatgggtaaaattgcaagtctacttagtaatgagtcaaaaattccactaacaccattgcaacgacgtctagttcaattaggaaaaaatatctcttgggtagctataggtgccgcagtggttgtgcttgggctaggtatttaccagggcatggatttgaagcatatctttttgacagcaatttcgctggccgttgcggttgttccagaaacattagcagtaattgttacaatgacgctggcgcttggcgtccaacgaatcgcacaaaagcatgcgattattcgacggttaccagcagtagaaaccttgggaacaacgaatgttattgcttccgataaaacgggtacattaacgcaaaataagatgactgttcgaagggtgtggcaagatgaacaggatcatttgactaatattgcagatggattggacgatgctactaaggaagtgttatctttggcagccatatcaaccaatgtttcggttaaaactgttgagggacagactgtttatgatggtctaccaacagaagtagcgttagtaagagctattgataaagaagcgacacgggaagagttgttagaaaagtatccgctagtcgaacagataccgtttaattcgacgaaaaaaagaatgaccaccgtccataagcaaccagaaggtggctacattgcgattaccaaaggtgcatttgatgttttgcttccaatgattaagcatgggaatcgtgataaagctgaaagtgttaacaaaacttttggtggacaggcattacgtgttctgacgattgctaaaagaacatttgatgttatgccggaagcgccaacacaagaattttatgaacaagatttgacattggtggggctagttggtattatcgatccgccacgcccagaatcggcaccagcagttgaaaaggctcgtcttgcaggtgttagaacaattatgattaccggagatcacgttgaaacggctagtgcaattgcacgtgaaattggcattttacgtaatggggatcaaacaattacaggttcagagttagctaaattatcagacaaagagctcgatggtaatgtccagaagtacagcgtatatgcccgtgtaacaccaactgacaaaattagaattattaaatcatggcaacgtcaagatgcaaccattgcgatgactggagatggtgtcaacgatgctccagcattaaaagcagcagatgttggtatttcgatgggtgagacagggacagatgttgcccgtgaagcttcggacatcattttgacagacgataattttgcgacgattattaatgctatttctgaaggacgtggtgtttatgttaaagttcgaaagacaattaatttcttattaagtgccaatatatccgagttattagtgatcttgatagccatgttgctggggtggggctcaccattgctacccgtacatctgttgttcattaacctggtatcagatggtttgccaggatttgctcttagtcgtgagccaatgttaaccaacgttatgaacgaaccgccgatgcctaaaaatactaagttatttgcacaagggttaggtcgtcaaatcggcttaaatgctgctttatttgcgattgttaccttggcagctatatgggttgggcaaaatgttgtctttggtggtttgcaagctaacgaacaaattggtcaaacaatggctttcaccattctgtcattgacttctatattccacgtgttcaatattcgttcagaaaagacgctttttgctattagttatcgtgcgaatccttcgttagttaacatggcaattttagcgacagtaattaccttagtgattacgttaataccatttacacagacgttatttggtttaacggcgctttcattaggacactggattgtgattatagttctttctttagcacctacaatcgttattgagttgttgaagtatgtgcgcccaacattgtttaaagtgtgataaatgaaaaagctttgtccttgagacaaagcttttttgttatatattttaaacctatttatgatcattaattcataatattttgatgtacttttttctggaaaaaggtttggtagatcaatacaatcattgtcagaatgattaacaaccagaatgctgttaagaatgggccagcatgtgtagttaatgagttcatttttcctaattcgcttaagaacaagggggttgagaaagacccaagatttgcgccaattaatagagttgagttagccaatgtttctgatccttttggtgctataacactgactagcgagaaaatataagatcctacaagtggatatgacataccgcaaacaacagcaccaagtgtgacaccaaaaacgctatgaaaactaaccataattaatgaaccgagcgccataaataaaatgcctaatggtaaaataaattttttaacaaaacgataaatacgtccgaaaagtatgcccattaccatgcccatcagtgtattagctgaaataatcaaacttgaaacggcgcttgattttgaaagatcagtgactataatatttggaacctgaataacaactgctgtagtacaagcaaccatgaatgctaataacaccgtcataatgaggacaggtaagttaatacgctgtttaccattaccgctaccttgtgggataggtggttctggcactacttttaaaaagaaggctagtagtgggaaagccaaaagatagattaaaaatgaagcatgccagttaattagcacgagtaagccaacgacaatgtttaaaattgaaacaccaatttgttccgtagcagaacgaaaaccaagcatttgagaacgcgtagggtcttcgtaaaataaatcaatgatagtgatggcaagtgaattaaacaggccaataccacaccccacgattaaccttgaaattaaaattaagataaaactatgggagaaaaatggaaatacaccggctacgcccgttaaaattaatccaattgtaatcgttctcttaataccaagctttttggaaatgaaaccagagagaagtaatgttatcataactgaaaattgctgtatggtagcaatcatatcaatttgtgatacggaaatatttgggaaactcttcgccatttcaggtaatgcagaggaaatggctgtacctgttgtgatcataacagatacggataaaacagctagaacaaaaattttagaatgaggatttttttgattcaaaatagcaccttctttttgtcagaaattttgattatttcgtcaaaagataaactttgctttcatatgggcgtaaggttgttccctgatcatctaaatagttattgattaacaattctgagaacttcgtttgtccatagtcacgagtgactactttgtcagtgaagttgctcaaaacaagaacagactgttctttatagtgacgaaggtatgcgtatacctggttgtcttcagaatcaatcgcttcaaacgttccatatctaacaatctctgaatcatgacgaagttgtattagcttctggtaatggtagtaaacggaatcgttatcagataaaacattttcggcattgattgctgtgtaatttttgtttggtgcgtaccaaggtgtcacatttgaaaatccggcattttgttggttattccattgcataggggttctcgcattatcacgtgacatattagctaaatactttagcattgttgcgctgtcaacaatcttttgctcatcaacaaactcgtgataaaagttgactgactcaatatcttcatattgttccaaactctcaaaatgaccgttagtcatacctagctcttcaccttgataaacgtagggtgttccttgcatcatatgcaaggtagttgctaacattttagcagataatactctgaattcaggttgatcatttccaaatcgagaaactgcacgtggctggtcatgattattccagtagagactattccatcccttgccatctaatccaatttgccaacgatttaaggaagctttcaactccactaggttaataggttcgtcattccatttacccagtcgtacgtccggatttgggctgagggaaacatgttcgaattggaagaccatgttcaattcatgactatctaatccagtatatttaatcgcatcttcaggggttgagctaggcatttcaccaacagtaattgtgtcgtatttggacagtacttcgtcgttcatttggcgtaaaaattcgttaagtcggtgaccatctgctacaaaatccattgttgttcctgcagttactggttctgtgacatcaggcaagccttcaggtttagaaattaaattgattacatccattcgaaatccatcaacacctttatccaaccaaaagcgttcaatatcgaaaactgcctcgcgaacctcaggattttcccaattgagatctggttgtccttcagcaaacatgtgtagatagtattgctttcgttcaggaacataagtccaagcagaaccgccaaatgctgcaagccaattgtttggttcatgtccgtctactggatcccgccaaatataataattggcgtactcgttagtttgactcttgcgactttctttaaaccaaacatgttgatctgacgtatgattaacaaccaaatccatcataattttaagatctaggcgatgtgcttgttgaagtaaatcttcaaaatcctgcattgtgccataatttgggttaatattgcgataatcagcaatatcgtagccgttgtctttatttggagagacataaataggatttaaccagatgacatcagcacccaagttatggatatactgcaatcgttgagtgataccagcaaggtcaccaataccatcgttattactgtcttgaaaactcataggatatatttgatatactactgagtccttaaaccattgttttgtcattgtttgattctcctttttattttgtactcatagattaccactttgcgtaaacgtttacaattcatttataccagtacagtaaacgtttacttagtgtaataattgatttaatcataagggcacgacaaaaataagaatttatttaatttatacgatggagtagtgttgggatataataaaatgaggtagtaagttagaaaacggggttaatgatgtcagttacaattaaagatgttgctaaaaaagcaaatgtttcaatcgcaactgtttccagagtgttagcgggtaaaaaagaggcctactctctagcaactgaaaaaagagttcataaagcaattcaagaattgggctacaaaaaaaataaagccgcagtagaattggtgaccatgaaaagcaatgttattgcaattttggtatcaacgcccaaaacaaattttgcgatgaaaatcattgaaagtattcaaaaaaatgcctataagaaggatttgagtgtgataattttatttgtgggtgataatgatgaagagacgcaaattaaagcacttaatactgttattgagcgaccggtcaagggcatattattaatttccgtagaattatgtggtgatgctatcaatctactaaagaatagtggcatttcgaatgtatttgtttcaactgcaatgagtaaagaatcaaagtttgtttcttcagatgattttaaaataggatatgaagcaaccaagtttttgattcacaaagggcacaaaaaaattggtttatcaagtttggaagtggacaaatttataggtcagcaacgagtagccggctatttgtcagctctgaaggaccatcatattcctcaaaatgatgattggatttttgatggcgattactcatatgaaagtggtgtagcatcaatgcaatattatgcatcacaaacggatataacagcagttattggcgcgagcgacttggcagcaataggcattattaatacagctcaaaaattagatattaatgtaccagatcaactagcagtgatcagcattgacggcacttatttagttgatattgttagccctcgtatcacgagcgtcacacagtcattctataatatgggagaaactgctttaaaaatgttgtttagtaaaggcaatgagtccagttacatttatacctcttttcagatagacgaacgcgagagtagttgaataaaacgagaatgatttcagaatatatttgtactaaaaagacccctatacattcatcatgtgatgtgtgcatggcggtctttttacagttgcagacatttagcgcgaaatggactttatatgggctcgaagtgttatgaccaaaccaacaataattaaaaaaataccaattgccgcaccaaacaatcctgttgatgacgaagcactaggtgaattttcataggacagtagtgcatattgtgtcatcacaatggcaactaatccatcagctaaatttaatgattttaaataagtaataattggactacgaaaatgacgagctttaatccagccaacgatggatgtcacaattttagtgaagccaattagtgcaattagcaacacaatactctgattatatcgttgcggttcgtttacgatatacatataaatcgataatgtaacaagagccatgcccagtaaaccgtataagataccaccttctcgcaagtatctaatttcaattttttctcgctctaagggatttatgtttgaaactctaatttgacgatatcgccacaaaaagtatgatcgaatagccagtaaaataatataatagccaccaaatattaaaaaccataaagataaaaagaatataccaatagttaatttgataagcgcaaataccaaattagatattgtgcttgcggcattatatagaactacacgatcagatttttctgaaatgtgatgtcttaagttgtgatgatcaatgatgtcattaaattttgtcgttatttttttgatgagctgcatatgattatctttcgtggaatgatatatggcgtccagttaatcagttaaagaattcaattctcattgtatcaaaaatttgctgataaaacgcagtaacgcttaagattaacaaattgtaaacaaaagtatcggtattttgattaataaaacgtcattaacaaaaccgaaacaaaaccttagcaatttataaacaaagtaattagataattaattcaatcaaaaggataaaggagataagagatggcaattgtattaaatatcattatcggagttgtgacagggttaggtatcgcatttttgggaaatgtggtgaagcaacctggtacagtattgaggaaaaacatcacccttggcactggtattttgttaggtagcttgggtgcagtttcggctgatcaactactaaattacggacccacactgatggaaactaactttgtaccagccattgcaggcggcatagtgttatcatttgtcggcgtatacgcaggaaaacgatggttacatttaggcacaaactaaaaggatagtggaatctaatgaagaaaaatgactttataatcatgctagggtggattagtagtggctttctattcgcaattgggatgtgtatggttttactaccggaatggggcgtagagttacaaggtgcaattctaggtggcgttggtattattagtgctctagctgtatttttggctaaacgtaaaatggcaggaaaagcgttatggatttggaatactagaatcgtagtaatcagtttgtttggttttgttagtgcgatcgtatttggattaggaatggtaatgacaatggtttgggggatgatgactttgggtattattctaggatttgttggcgtactgatgttagctgccttgctaccaatggttaagggatttgaagaataaggctgaactcaattattatttttaacattagaaaaggcattgttgattatataacgatgcttttttgtgtcgatatgcgaactcgtgttccctttttctatatgataagctatttaaatattaagaaagaggaatgatacatgaaaacagcagtgtttcttttgttaaacgaatatgcagattgggaaggtgcctatctatcaagtcaattaaatcaattaaccgattggacagtcaaaactgcttccattcaaaaaactatacactccattggtggttttcagactaaagcagactactctattaatgagattcctctagaaaccgagttacttgttttgattggtggtaattcatggcatatcaacagccttgaaattactaatctaatcaaaaatcgtttagtcgcggggaaaacggtggcggctatttgtggtgcagttgatttcttggccaaaaatggtctattgaatgataaaaaacatactggtaattcagtatatttgtggcagagttatgagcaatatacaaacttgtctagattcttggaagaacaagttgtagtagatgaacctttaattactgccaatggaacagcaaccttagagtttacaaatcaagttatgaaaacagttcacgcactgccagtagatcaaattgataaaacaaccaatctgtacaaactgggattttacaagtattgtgacaaattcggtaatccctatgcttagcgaatgagcttgcatttattcatgatttggtttaccttcaagtaagtaaataaaggacacaaattatgaaatataaaatttttatagttgaggataatcaagaaatcgtaagcctgctgaaaaagggtttgattagttggggactaagtgcagttagttgtaaagattttaatcaagttgaagaggaaattacaatgcattcaccacatttagtgttgatggatattaatttaccttactataatggctttttttggacacagaaaatacgtcaaaatagcatgataccgataatttttttatctagtcgtgatgaagaaagtgatatgattctggctatgaatttcggcgcagatgattacattactaagccgtttaacatagatttattaatcgtaaaaattaatgcattgctgagacgcgaatatagctttagtgtagagaaaaagcattctcaatttcaaggttataccttgaatattattgataatcagttaatatatgacagtcgagaggtagttctctccaaaaatgaaacaaagctattgtatcttttatttactcatccaaatcaacttgttaccagagaggacattatggctactttgtgggataacgagatgtttgttgataagaatacgttagcggtcacgctaacgagattgcgtaacaaagtaacagaaattggattttcaaagtatttacaaactgtcaaaggtaaggggattaagcttagtgattaaaaaaatatttggcttagcgttgcagtttttatctgacttttggtatctgtacgcctcatttatgttaacttttcttttgctaatgtggagcgtgattatgcgatcactaagtttagactcgatgttcgatgtcctttggggtggttgttatattttaattgtaattacttgtattttattttggaaatggtaccgagcacacaagggactgattcagttgctgtgcgaagaagaggtacatacattatcaagcattgcgaccttgtctagtcacgaacgaatgtaccaacaattaattaaaaagcaacaattgcatcaagaaaaaatgcaggcacagttaaatgaagatgcaaatgacattcaagattactatgcaatgtgggcccatcaaattaaagtaccgctgtccgttttagatttaatgaatcaaactgggacaattgaaaaatatgaaactagtaatcaattgttagtggtcaatcagtatttggatatgatgttgcagtttattcgtttaaaaaacttcaatcaggatatagcgtaccaggatatgagtgtccaaaagtctttaagatcggtgatcaaagattataaatattggttcatccataaagatttagctgttagcataaatgaatttgatttttctgtcgttagtgatgccaaatggcttcgatttgtatttgaacaagttatatttaatgcaattaaatatacacctcagggcaaaataaatattatttgtcaaaatgacaatcaggtcattattaaagacacgggcattggtattgcgcaaaatgatttaccaatgatttttaatcaaggctatacaggatttaatgggcgcattaatagtaatgcgagtggtcttggtttatacatggttaaaagaattttaaataatttaggtcacgatataaccattcaatctgaagtaaatgttggtacaacagtcataattaattttcaacaaactgtaattaaataaaccttacaaagttgtaaggtgtggagatgatatgtaaggttaatcatctcttttttaatttaaaatagaattatgataaacgatataggagaataaaattcatgacactacttaaagttgagaatttgaaaaaagaatatcagagtaaatttaaaaataatacagttgttgccttggcggatgtcagttttgaggtagagaagggtgagttcattgcaatcatgggtgagtctggttcaggtaaatcgactttgctaaactgcattgccacacttgatcaaccaacagcaggaactatttctttaaataatcagaatttcaaacatttgtcagataaacaattagctgcctttcgccgagatcatctaggatttgtgttccaggattttaatttgcttgatacaatgtcggttgcggataatatatatttaccgcttatactagctaaaaatacaaataataaggagcagaaactgagtaatcttgccaaacagttgggattacaagatctattgaataagtatccatatgagttatctggcggacaaaaacagcgagtggctattggcagagcgttgatcaccaatccagaaattttattagctgatgaaccaacaggagctttagattctaagaattcagctgatattttgtcaatatttgaacaatataatcagcaaaatcaaacaatattaatggttacgcattctgctttggccgctagtcatgctcaaagagttttatttattaaagatggaaaagtgttccatcagacataccgagggaataaaacggagcaagaaatgttactgacaattagtgatgccatgactaatttattaggggggattgattaaaatgttgtattggaaattagcttggcaatcaattgtaaaaaacaggttagagtacttaccatttatgttagcaggcagtgctgctgtcgctttgaacatggttattcagttacttatttattcaaaaggggtcaaaaaattagcagccaatgtatctgtaattgaaatgcttactttttctcaaatcgtaattgctattttttctattatttttctgctctatacctatagttttctaagtaaacgaaaacagtcagagtttggtcttttcagcattttagggttacaaaaaattgatctgattaaaattagctggagacaacaatttatttcttttctggcagttactttttttggcctcattactggtgttgtgttcagtaaagtattaatcttactatttatgaagctcgtgggtggtaccgaattccagctaaacatcacaaccgtgtcaatagtatttattgtcgtattttttatgatatgttttttattcttgctgataacagacatattttcgatttttaaacttaaaaccatatctttattgcatgcaactaaaaagggagaatcagaacccagaagccattgggtattatttggccttggactagtcctgctaacaatgggatattatatttccttaacggttcattcacctttaaaagcaattggtcaattctttatagctgtactgttagttgtttgtgcgacatatattctgttcatcgtagcttcgacgattattttaaaagtaatgaaacgaaatggaaagtattactaccaagcaaatcattttataactgtgtcgaatatgttatttagaatgaagcagaatgcaacaggtctggctagcattacgctattaacaactatgtcgctggttgttattgttacaacagtttcaatgtttgttggacaagaagactacatcaatcaacaatttccgcgggctgttattttgacaagctcatctgaccgtaaagtgcccattaagtctgtgagaaaagttgctagtaataatggtataaaaatagacaaaccctacaaattagaaattagtactgcgatagctggggatttaacgactcaagggaagctacaacctttaactggtgattccgttgggagtgccgacaatttgtctgaaatccagttcataacagaaaaacagtataaatatatggccaataatagctcaaacaagttaaaggctaatgaaatatatgtctatgatagacaaggaacattcaatgggggcaatatcacttttttgggtaaaaactaccatgtgaaaagcgtgttgaaaaagattaaagggattcctagtgttcagcctaatatgacacattcactgatagtagttgtgccttctaagagtgttacaagtgctctaggaaacgagtttaatgatttaggtgatacgaaacagaatattacttataagaaccagttattattcaatgtcacaggtactgagcagcaaagagaaaaattcttaaaagaggtatctcaaacatacaatattacgagtgaagatagattttcaacaatatctgtattaaaagaattttatggtggctttttctttattggtttagtattctcagttagttttattatggcaactggtttgattatttattataagcaaatatctgagggacgttctgaccaaaagcaattcgatattttgcaaaaaataggcatgtccagtcaagaagttaagcaaacgattcgttcacaaatcatttggatatttggtctacctgtggttgtcgcgattatgcacttatgttttgcgatgccaatgattcataaaattctgcaattgtttggtataattattggtccagtagtttatctgaccactgtactaacagtgatctcgatagttgtaatttattacttaatctatctgaaaacatcgaaaacatattatcagcaggtttcaagaaaaatatcttagaagtgtgttagaaaaaataaaaaaagcgatttcaatcactgaagtcgctttttaaatttggcaaaattaaacttataaaaatcaattaaagttttttaaaactgcagttgcttgatcggtaatcatttgcgacacgattttaattgcaggaattcttttttgtggcttacgttctaaaaggtagatttgtctcttgcttttagtatcgaaatcatgaacaaaaattccattcatatcagtacccgcagtaagtgctaaggaaggcaaaatggagataccgagttgtgatttcactaagctttttatagcatcataactgtgaatttcactaacgacatcagggtcaaataaattttctcggcatatttggatgatatgattggataaatatgtattcttgggttctatgatccacttttttgatgctaagtctgaaaagtgcttaattgggaaaatacttttatcgtctttacttgagactactaataatttatcttcgccaatattggtcgatatgatgtccgaattgggaaaagtgacctttttttcaaaataaccggataaaacaatatcaaatttgtgtgaccgaagtcctaataagctttggtcgggttcttcttcatatattctgcattctatacttggaaaagtttgattaatcttttttatgacaggaataagtatagaatttaatgcgctagtgaaagttgcaattctaacaatgccagtaatttcactttgtcgtgttttaaaatcattttcgatcgtttctaattcagataaaactggctgggctctctccactagttcttgtccagtttggttcagataaactttccgtccttgtttttcaatcagcgttaattctaaatcgtcttcaaggtcttttaattgctgtgatattgttgcaggactaacaaataaagcatcagcaactcgattcattgttcctagttcggctaggtgggttaaaatttgcagttgccaaatattcattcatattacctcaatcatttagaaaaactgaactatatcgtcagatactttatcttttcattaattttatattgctttaaaattaatttcaagttaactattaattgaaagaggtatctaaatatgatagaagcatttgaaaaatcacaggaaccgtgggctgatgtagaaaaatatgttggtcggtacgctggaatggattttagtcccgatattattgatcacgcaaaaggaacctacttgtttacagaatcaggtgaaaaaatacttgattttacatcagggcagatgagttctacattaggacattcaaatccggaaattgttacgactttacagcaaaccgtacaacgattggatcatttatatagcggaatgctttcgcgacctaatattaatttgtctaaaaacattgccagtaaaacagggggaaatttaaaaaaagttattccgttgtcgactgggtcggaagttaatgaagccgctttgagaatggctaaattggtcacaggcaaatttgaggttgtctcttttaataaatcatggcacggtgtgacgcaggctagcgctggtgctacctatgcctcagctagaaaatcaggggcaccaacgtctccaggtcaactttcaattccaacgccgtatacataccgtcccagttttttcaattcagaaggagaatacgattggcacaaagaactagattatggatttgaaatggttgatgcacaatcggttggtagcctagcggcttgcattgtggaaccaattgtatcgggtggtggtattctggtgcccccaaaaggatacttggcagcactaaaagaaaaatgtcgcgaacgtggtatgctactgatatttgatgaagcgcaaactagcttaggtagaactggtgaatggtttgcatatcagtacgatgacgttgaacctgatattttgactttatcaaaaacattgggttcgggtctacccttggcagcattagttacgacggataaaattgaaaaaaaggctcatgaaaaaggatttcttttttatacatcgcacgtaaacgatcccttggtagcagctgttggttgcacagttatgaatattattgaacgtgataatttatgccaagtaaccaaggaaaaaggaaattatttacatgacggattgcagaaactagtcgataaatatgatattgttggggatgctcgcggtcgtgggcttctgcaaggattagaaattataaaaagtaaaagcaataaagaaagatctgaatttattggtgatgaaattacaaaacgctgttataaactagggcttcatatgaacattgttaatctgccagggatgggtggtgtgttcaggatagctccaccattaactgttagttatgaggaattagatagcggtctggcaatcctagaacagtctattaaatctgttcaaaatgatattaaccttggtactttatagaatactcaaaggagaataattatttttgaaaatattaaaatgatcagaaattacgatcccgccatttcttctaatttgcaaattattttaacttattctggtttgcatgccgtttggttttatcgcattagtcatcagttgtggcaactcaatttgaagcttcttgcgcatctatgttcgcaatggggacgtttaatcacgggagtcgagatacatcctggcgcgcaaattgggagacgtctgttaattgaccacggttctggaactgtgattggtgaaacagcaattattggtgatgatgttattttatatcatggtgtaactctaggcagcacccatcatgcacttggagatacaagtcgccggcacccaaaaatcggcaatcacacattgattggtgcccatgctactattttgggaaatattacaattggaaatcatgtgaagattggagctgcaacagtggtcttacatgatgttccaagccacgtgactatcgttggtaatcctgcgcatatattgcacaaaaatccgaatatctaataaaataatgtaatattatcataattgtgttagaatgtatgatattctagacgttatgagggaaaattatgagtgtttactttgaaagtgcgatagagaatcatcttgctatcgcggtgaccgaactaagccatgccgatgaaatatttgagttactctataatgatcaagaaaacatcggtcaatttcttgggtttgtggcattaacaaaaacaaaagaagacgaagttaattatataaagaaaaaaatgcatggtatcgcagatggtactgatgccttgttttcaattattcgagataatcatattgtgggtgtaattgatcttcattatattgattcagagaacaaaaaagcagagataggatattggctacattcaaaattccagcatcagggtatcatgaccaagtctgtccgtaagatttgtgagtatgcttttgaaaatattggtttgaataagttatcattgtttgccgatgtagagaatattggcagtaatgcagttgccaaacacgcaggtttttcatatttggcaactcatccggattactatgttcatcgtggtcaattgcgcgatatgaatgagtattatctgctcaaacgagaattttaaatgtaataattaagcatgaaaacagtattgttgattaacctgctatataattaagctaattaatagttagttgaatgtagagaggagaatcatgtcacataatcaaaaagaaagtaataaggctttgaaattgggcattggcaccaacaaagtgggcggtcataatttattcgagggcctacaagatgaagacggctttgatatagttcgggaagcattggattcgaaggtccaaatgattgatacggcttatatgtatggtcttggtcgctcagaagaaatcattggtgaagttcttaaaaagtacccccgctcaagctttaaaattgctactaaagcggcacaagatccagaaaatgatttaaaaataaataatacaccaacttttcttaaaaaagcagttgatgatgccttggcaagacttcagacggactatattgatattttctatattcattttcctgatgaaaacacgcccaaagatgaagcagttgctgctttaaatgatttgaagaaatctgggaaaattcgtgcagtcggtgtgtcaaacttcagtttagaacaaattaaagaagctaataaaaatggtcaagtagactatgtagaagatgcatatagtttagtgcaccgcgaagcggaaaataaattatggccatacttgcaagaaaaccatattagttttgtgccatattttccattggcttctggattgttaacaggaaagtacagcttggcggatgctgataagtttgatcagtttacaaaagagcaatttgaaacaattatctctgccttaaaacttgttgagaaaatagcggaaaatcacaatgcttcaatttcgcaaactattctggcttggtatattgctaatcccagtatcagtgcggttattcctggggcgcgtaatgcaagccaagtgaccaataacgttgctacattaaacattgacttaactgaaacagaatatcagcaaattgacactgcctttgaaaatttttaggtagtgttgtactataaatttatatgaaaaagcaagtcatattactgacttgcttttttacgctattcacactttagaaagaaggaatggatatggaaaaatatcatcgtgcatttggcgtttatggcattatttattcaagcagcaaagggattgttgtcataaaaaagaatggtggaccttacattaatcgttttgatttgccgggtggcagtttagaagatggtgaagaattatcgcttgctattaaacgtgaaatagcagaagaaacaggtttgacggttcagaaatatagtcagttgggaattactagttttaaatatccttgggattatttaaattaccactataatcaacacatcgctgtattttatgatgttgaagagttgtctggcaaaattgaagagatagcaccacagtttgatgggcaagattcattaggcgctgtttttataccgcttgaaaatattagtattcgtaatgcttcaccattggttttaaaagcaaaggaatacttattgaataatcgtcgttttgaagatgaagatacgatatttgatgagtggaccgtgttggaaaatgctgtattttaagaaaagtactgattgttaacagtcagtacttttttattgatgacttttacgatattgatagggagtattttcagtccattttttaaattgtcgtgaaaaatgagcgggatctcggtaacccagcgcttcactaatgtcaatcacactcaaatcaggcatttgcagtaaccgcttggcttgggcaatttttaattttgttaaatattgtcgtggcgcgtatccataaatgtttctaaacacttctccgccataacttggactaatttttaaatcactataaattttgtcgatacttaagcgtgacgaatgatcgctaacaatgaaatcttcgttaaaatagctgtggatatttttttgcaaagtagttcttataccataagcaattgaactggctattttaagttgtgaggagttaagtggtgtgtgttctaatatttcactagaaaataattggaaaataaaatcagacagtaacacgtgaagtttcaactcatccttaaaagtgtacgccatattcttatttaatacatcccgtaatttgtccaaactttttataagagggatattttttagtgagccgttaggaaaattaaggataccctgatttattaaatttgtgacgaatcgttcatcatctaaattgaaatgaaaattaaagtaggttgtatttgttagactagttgtttcgtgccatacattgggatataaaaccataatatctccagattctaggcgaattgtattatcaaaggccgttacattgattgcgccttcgacaatgtaaaatacttcaaatgccagatgacgttcagaagggtagtgccagccagatttgatatcttgctgatgaccgccaaagaaagagatgttccaatctaatgcgggtaatcgtattgagccttggagctcttttttttcgaatgatttcatttgataacctcaaaaagggctgttttatcataaataaagcgcttacatttaagataattatgccccctaatgaaagcgttatcaagagttgtaattttattctaacacaaaggaaggaacagtatgaacaaaaataaggaattattgtttggcgttgcctattattttgagtatttgccctacgatcgtattgatcaagatatcaaaatgatgcaagaagctaaaattaatgtcgtcagaattggagaaagtacttggagtacctacgaaccacaagatggtgtatttgattttagcaaactgatttatacgctaaataaaatgagggatgcaaagatatcggttattgtgggcacgccgacgtatgcatttcctacttggttggctaggaagtttcctgaggtgcttgttgaaaataatgggaaccggctaccttacggtgccaggcagataatggatattaccagtccaatttatcgatattattctgagcgaatcattcgtcatatgttgcaggaaacggttgattacgacaatatcattggctatcaagtcgataatgaaaccaagcactatggcacatctgcaagtcacgtacaggccggctttgttgaagaaattaaagaaaaattttctggtgatcttgatacattcaataaagagtttggtcttgactattggtcgaatcgtattaacacgtgggaggactttccgaatgtaaacggtacaattaacggcagtttagcaggtgagtttgcaaaataccaacgttcattagtgaaggaatacttaagttggcaagttgacttggtcaatgagtataaaaaagattttcaatttgtaacacacaattttgattttgaatggcgtgattattcgtatggcattcaaccagatgtcaatcattttgaagcagctgaaccgttagactttgtgggaattgacgtctatcatccctcacaaagtcagcttacagggatagaaaattcttttgctggcgatgttgcgcgttcaattaagcatcaaaattatttagtgctagaaacgcaggcacaagcatttaaaagctggacaccatatccaggacaactttatcaacttgcttttaaccatatcgccaatggcgcgaacatgattgaatattggcactggcattctatccataattctttcgagacgtattggaaaggattactgagtcatgattttgaaccaaatccagtttatgaagaggctcaaaaagtgggacatgactttgaccgtttgtctgataagttagtcaacttaaatcatgcagcagacgtagcgtttgtggtagataacgaaagtctcacagcaacatctagtgattggatagagtttgcgattggaaaagacgtaaactacaatgatgtatttcgaagattgtacgatacattttacaaattaaatgtccgaaccgatattttgaatccaaagacaattaatttgagtgattacgcattagttgtcgtaccaatgttatatgtcagtgacgaaacctttttgaaagcgttaaatcagtacattcatgacggtggcaatgtattgttcacgtttaaagacggtgtgactgatgaacatgtcaaagtacggactgatatacaaccagcaattattcgagaagcaattggtgcgcattatcacatgtttgtcgaccccaacggtgagacattagaagatcaaactggcatatttgaagatactgatttgcacatcagtgagtgggctgaattgctcgagagtgacggagcaacaattttagcctcatataataatcattggaaaaaatttggtgctattacagaaaacaaatatggtaatggtatggcatggtatttaggtgcttggccaagccagtctgttacgaatgctctagtaaagcatgttatcaatcaatcaggaatttcccaatctgattatgatgtaacttttccagtgattgttaaatcagcaaaaaatgagtacggcgcgaacattgattttctgttcaatttttcggatacgagtacaagccttgctacgcctttctcaggtatggagctaatcaaacaagaacacatggctcaaggtagtcaagtgacattgcaaccttgggatgtaaaaattatagaaagaagtaactgataatggataagacagtagatgctcaaattaaattgggcaaaaaagatggatttcgattcacgatatcctatttcttgttctcattgttgtggatggctggattggcaattatagctgcagttcttttgccacaacatttgcgaaatgtggtaggagccgaaggttccacagccgtgtttggtgttttaaacgcagcaaccgccataacctcattattatcaaacttaatcgttggtaatttatcagatcgcacgcgttctcgctttggccaacgtacaccatggattgttgcaggtggtgttatcggcggtgtatccttgtttgctatcggtctgtttcaaaatgtctggttgatcggtgttagttactgtatcagtatgattggtttaaatatgatgattgcgccagctatggcgactctgtcagatcgagttcctgaaaacttgcgtgcaacgacatcagccttttattcagctggtactaccgttggaacgtcgcttggaaccttgattggtgcccgctttattacgttacagaccccaggatttattacagccggtatcctaatgggtattgcaggtattgcgacagttatcgtttggccacacgagcgttctgcaaagtcattaccatcagttacaggtggcgttaaggaattattagcttcatttcgtccaccgcttaaaggcgcccgtgatttttggttagcctttaccggtaggtcattattaattttttcatactacatgattttgaattatcagttatatattttgttaagttatattggtcaaagtgaaacagctgctgctgcgactatttcggtcatgtcaatcgtgacaatggttgtcggactagttggttcactagtttcaggaagtttgtcagacaaatttggccgccgaaagctaccagtaaatattgcaaccttgctcatgtcaattgggtttttgttaccatggattatgaagtcaccattctcaatgattctgtttgcaggattctcaggactaggttatgcggtgtatggtgcggttgatcaagcgttgaatatagatgttttgcctaacaagaatgaatcgggtaaggatttaggaatcttaaacatggcaaccacattaggccagacagttggtccaattgttacgagtattttagttggatttggtggatataatttggtatttccaacagctgttgttttttctgcactagctatgatatttatccaaatgattaagtcgacaaagtaaaggagaatttagacaatgattaaaggtgttaatttaggtggatggcttgttttggaaaagtggatggcgccacaattatttgatggtgtggaagcagaagatgagtattatttgccacgtgacttaagtgaaacagaatacagaacacgcataaatatgcaccgggctaattttattacggaggctgatttcttaaacatcgctagtttaggaattgacacgatacgtattccagttccttattttatctttggtgatgtgccaccatttattggtgctatcgattatcttgataaagcctttagttgggctgaagcatataaccttaaaattttaattgatttgcatacagttcctgggagtcaaaatggttttgacaatggtggtatatctggcgttcagaactgggcacaacactcagaccaagtagattttgctatttcagttttgcgtcgtttggccgaacgctatgggcaaagagttggattatatggtattgaagtattaaatgaacctgcaacggccgaaatgtttcaaacaatgcttgatcggtataagcctcgtgatccggagatggcattggaaaacgcaccgattacctttaagtttctatacgaattttataagcaagcatacatcaaattacgagaagtactaccgcttgataaggtggttatgtttcatgatgggtttgatatttcaaaatgggcggacttttttaagaaaaatgaatttgagaatgttgtattagatacccaccaatacctaatgattgctgaaatgaagacaggcgagttaacacttgattcgtatcatcaatacatgaatgagattggggatgcgattgctaaggttagagaattcgttccagtagtggtgggtgaatggactttgtttaattctttggccacaggttcagacaccaaaggtggtgttagtcctgttcaaaaggtatttgatcaagaagtagaaattgatcaaaatagtgcgctgagtatttatcaagatctttggaacttacaaattgagcagtggcaacgtgtcgatggttattttttctggagttacaaaattaatattgacacaattaatgataaggagtggttcggctgggattcttggtcactcgaaaggtctgtcaacaaaaaatgggccaagatttaaacatactgaggcgattaattgaaagagagtgatcatatgttaaaaataaaaaacccgattattcctggaatggcacctgatccatccatcattagggtagaaaataaatattatattgctacttcaacctttcattggacacctgcaattcagctatttgaatcaactgacttaaaaaattggcaattaattgatcatgttttgaaaaaagaagagatctctttgaagggaacaaacacaccagcaggaatttgggcgccacatctatcctatgatgcacacaaaaaacgttattggattgcttattcgcacatgttaaacatggcgggtcgagaatttaatgccgattcgtatgcgctttggtcggaaagtattcacggcccttggtcagagccaatttacctcacatcaataggctttgatccatctatttttcatgacgacgatggcaagaaatatattgctatcttagaatgggagtcaaggccaaattatcaagcaccagggcatattgtcatagctgaattcaactttgaaaagcagaaaattgttggttcgtggcatcgagtgactaccggatttacttcaaggggtgctgctgaagcaccaataatttacaaaagaaacggttactattatcttatgattgcagctggggggacagggtatgcccatagtgtcgaaattggtcgatcaaaggacatatttggaccttatgaatcacatcctagtggcgaaccaattattacttcctcaccggaacaccttttttccctaggagatcctgatgctggacaatttgagatgtataatccaaattctaatatacaaaagtcgggccacggttctttggtggagacacccaatggtgagtggtacgttgcccatttgatgtcacgcccattacctggtacgacattgaatccattaggacgagaaactggtatccagaaagtaaattggacggcagacggttggttacaaatggctgacggcacaaattttgctaaggaaaatatcgatggcccacaacaagaagaagcaacaataaaatattctgaagatattacggagtactttaatgagcctcattatgacaagcgatttttatccccgtatcgttttcagaatagaacatgggtcaatcatttaggaaatagagattacttaagaatttatggcggcgagtcacttttctcacaaatgaatccaagtattttagctacacgagctacatcgttcacttattctctagaaactgaagtggaaattcatccagatcattattctgaatcagctggagcagggctatattatgatgctaataattggttgtatgcaaatttatactggtcagaatcattaaacgcgatagcattaggtttaacacaagcaaagttgggtgagaaaaaaatttatcagtatgttaaggtgcctatttcaaatggacacgttcaaataaaatttgtctataattttggtgaagcgacagtgttttatagaatgtctaccgacgatgaatggctgatattactagaaaatgttgatgttaattatttatctgatgaaggggttaatggggaaaaaggtgaaattggaggtttcacggggctgttcaacttcatagcggtcactgatgcacatcagcatgatggttacggcgacttttcgttctataaagtgacgagtctttgatgtattatttgttttaataataaattccaacatactaagtgtgttggaatttttataaggtgttgtctaattatttgctaataaacctcttaacattcaaaaacagatgtgataggatatttatatcgcttcaatcgactaaaattttaggaattgagaataatctatgtcgttatcacaacaacaattgaatgatttttggagtggcgtaaaggcttccctgccaaccatgctaggttatattagtattggcgcagcatttggaacaatagctggctcagaacactttactatttggcaagtctttttgctgtcagcgattttttatgctggttctggacagtttattgttgttagtatgctggctgccaatgcttctattagcagtattgtcatgatggtttttttggttaactttcgcatgtttttacaatcattaacggttacacaggtttttccacggcaatctacagtatctagtttgcttatgggtagtttagtaactgacgaatcatttggcatactatctgtgaatattgctgctggcaaggaaagatcagtgatgtggatgcatggcttaaatattgcttcgtgggcaacgtggtggctagcttgtgttatttttgcagtagttggcaaaaacattactgatcctgcagcattcggcttggattttgctttaacgggaatgtttgccggactttggttgctgacaagcatttctatgttccaaaatccgaaggaaagcaggtttaaggtgctgtcaattataattgtttctacgactttgttatatatacttatgtatttctttagcgcagttgtgtctgtattgatagcctctgttttgggaagtttttacgccgttttggtaaatagaagtgagggtaagtgatatgagtgatacgaaattttatatcgtccttctaggtagtattattgtgacacttattcctagagtaatacctttttttatggctaagtatattaattttccagattggatgacgacatttttaaggtatttaccgttagcaatgatgacaacacttatgtttcaaaatatatttgttgttcatgggtacgggcatctggcgacagtgaactttactgctttagtagcattgttgcccggtttaattattggttattttaggcgttctctgatggctgtagttttattgagcgtgctagtaatggctttgatgagatactttaatttttaaaaaagatagccatatacgatggttatctttttttgcttaaaaagtgcccaaataattgtaaatgtcggaatctgaaaattctaacaaagatgtcaataattttttcatggcaattagattatcaattctggattcgatttgagttattttatctgcaacaagcttttttaaatcgtctggggacatttgtttgctaagcatattcaggctttcttgaatctcttttaaagtgtaacctagcgatttggcatcttgaataaacttaatttttggtaaataagtttcatcatatatgcgataaccatttgctaaacgttttggttttggtagtagtccgcattgttcataataacgaattgtcgccgcactaagacctgttatttttgctagttggccacgagttagttgtttcatatcattttcctctaaaataattggttccactttatttcaatgacaaaatagcaagtttagcttgacattgaagttaacttcatcgtttataataacgttattgcagcgtgtttgcaacgataataaaaaatcaaaggatgttttaaatatggtacgaaaaaaatataagccgataatgtttctcataaagaatatggcaattatcataacgttttttattggtatcttgattgaaccgtattctccagatcaagccccattaaaaaatttaatcataataacttttcttttaatcgtgtgcatctacatattttcacgtcttgtcaattcgatttcaaaccatggtcgattattcgtacaccgcattgaactgtctacgtttcaaaaatattcatcactacttgcctttggttattttattttgctatatattattaatgaaaatattcaaagtatgttacatttgttccagagttcacctgaaattattgtcacttgtacagctatagctttgggtgccggatttttagaagaatatcttgtgagaggatatttattcaatctaactcagcggtttttaaaaaaatacaataacaaattgctcattacatcaatagtgactagtatcatattcggtttgttgcatctattcaatttaggattagataccactaagggcgttgctcagcaagttttctatgctttttgtattggtttatttttttctctggtaaaaattattacaaacagtattcacattggtgccatcttacactttttgtttgatttacaatttggcatatacgaaaatacttcaacacacatgagttggtcagtagtcatattattgtttcttcctttgactgttatcagtgtgattttgattaaatcattagaagcaacggtgaatgataatcaaaatttactaatggaagtttaattgcagtaaatattttcataaagctgcgcccatatcagtgtcctttcagtccatgacatgcaaaatggtatttgtttcgtagcatttttacaaaaaactagcaattagctggttttttttgatggattttctagactgcaatcttttgtagcagtgttttatgcttttgtgagaaggatagttcaatgtatttatttctcatatgaatgtttcacgagcacaatggtgccatatatttgtggcgtcaacagatagggtagaatattttgaacttgacattgaagtttacttcacagtttataataacattgttagttggcatttctagaaagtaaaaaggagaaaaatatgcgaattttagaaatattgttaacaataataaccttgttaagcctaatattttcagtatgggggcactggaaaaaaactacttactactggttattatcaaccatgctagttataggcggactgcatgtatttatcgataaagtacgtatccaaatgttaggcacatatttaatagcatttttatctatgggatacatgttatatcgcctaaaccaccaaaataatcaccggaaacacgctgttttgaaaggattatttacatttataagcatcttggtaatttctatatcaacattcatgagcatcattttacctgttttcaccatgccacaaccctcaggtaaatatggtataggtgaacagactcgaatcttggttgattcaagtcgatcggaaacattcacaaaaactagctctgataagcgaaatgtggctgttagtgtctggtatccgacaaataaaaaagcaatgacatcaaaacaaaaagaatcctatccaagtagtttaggcgaagcaatgagcttggtatttaatttaccgaaacaattatttagtcacttatcattagttaaaacgcacgttgtaaagaatgctagtatctctaatgataaaaagaattatccagtcgttttgttttcaccggggatacgttcaactagatatcaaagcatgtcagcgattgaagagcttgtcagtcgcggatacatcgttgttggtatggatcatccgtatacatcggctaaagtaacattatcaaatggtaaaactgcctattaccaagcagatccaaaatacaatacttctaaagggctctataactataatgtcaaaagtgtggcggttcgatctaaagatgttacttttgtaattgataaactgtctgcatggaatcagtcgaattctagatttactggaaagttaaatatgaataaaattggtatgtttggtcattccttcggtggtgcaacgacagctgaagcgttagcacaagataaccgtattaaagctggtgtgagtctggaaggggggttctggggtacggtagcaactaaaggtgtttcacaaccatttatgtacattatgtcaggtaatacggccaaaagcttaaagcctcatgcttctgttaaagagcaagtgacgtataaagaatttaaacctgatttgaattctgtcatgaagaagagtattaatgatacatactttttgacggtagataaattttaccatcaaagttttacggaaatttcttacatttcaccgcttctttttgcaagagggctgacaccataccatactgttgatattacaagaacgtatgttagtgatttctttgaccactatttgaaaggcgataaagaaaagctcttgactaagaaatctaataaataccctgaagtgattttcaataaacaatacacaaattcgaaaaaataagctatgcatgacaacagtatgataaactcaatgtatgattaattttatacaattgctacattgcaaagaataagattaaaacgatcatataaaaggactagcagtgccagaaacatttcggcgcatttttattaaatatggcaaataaatatgaaattgttaaaaaagacattttagaaaaaatattgagcggagaatacgataaaaatcaacagctgccaacagagagcgaaatgatgacagcattttctgtcagccgttataccgtacgacgtgctatttctgatttagaaaatgaaaagtatgtttatcgtgtgcaaggtggcggctcgtttgtggctgattggtcggctgcaaaaaaatatgaggaaattcccaaagtaattggtatcttatctactcatgtggcatcttatatttttccagcaattattgatggtgctgatcaagtgctatctgaaaatggattttcgcttattttggctaacacccataacgacccaaaacgtgaacgcacagcattaacaaatttgatgagccaaaatttgggtggattaatcattgaaccaacccaaagcgccatcgatacacctaatattgatttgtatcaaaaaattgcgcaactaaatattccgatggttttcattaatgcatcatacaataattttgaaggtaccacgttggtcagtgatgataaaaatgcaatctatcaggtaacggaatatttgattaaacgcggacataaaagaatcacaggtgtatttcaagtttctgatgttcaaggtattcatcgtttgaatggctttcttcagtcgtatcagaaccatccgaatatcttaccagagagttcctcgatcatgtataaatctgatgaagtgaatgaagcacttcaaaatatgcgtgaattgttggtgaaaaatccagatcagaggcccacagccgtcatcgcgtataatgatcaattagcgatacgcattgtcgatttgattcatgaggtggggcttaaagtaccacaagatatctccgtgattggttttgatgatttccaattatcacaatatttgtctcctaggttgacaacggtgtcacatgctaaagagaaaatgggacaagatgcggcaaggttgctgttacagaaaatcaaacatcacaaggtcgagtcgattgtctatcattctcaattgattgaaagagaatcagtaagtgatattagttaaattaaacggctaaaacaaagctaactagaatctatcttctagttagcttttttgtgtttttaaaaataagttatcgtataaaaatatatttatttgacttatacggacaaatgttttatagtttgtttgtaagcgtttccaaaaaatgattattctagatagtattgtttgattccgagtcgcttcaaaataactaatgtcgctacaagtacaaatacagaggatgaaaaatggctgatataaaagattacaagttttggtttgtgacaggatctcaatttctgtacggtcctgaagtactgaaacaagttgaagaagattcaaaaaaaattattgaaaagttaaatgaatcaggtaatttaccttatccaattgaatttaaaactgttggtgtgacagctgaaaacattactgaagcaatgaaagaagcaaattatgatgactctgttgctggtgttatcacatgggcacatacattttcaccagctaaaaactggattcgtggcacgcaattgctcaacaaaccattgctccatttggcaacccaaatgttgaacaatattccatacgattcaattgattttgattatatgaacttaaatcagtcagcacatggtgaccgtgaatatgcatttatcaatgctaggcttcgattgaataataaaattgtctttggacactgggctgatgaagccgttcaagtacaaatcggcaagtggatggatgttgcggttgcttacgaagaaagtttcaaaattaaagtagttacttttgctgataagatgcgtaatgttgcggtaactgatggtgacaaaatcgaagcgcaaattaaatttggctggacggttgactattggggtgttggcgacttagtgacgtatgttaacgcaattgatgatgctgatattgataatctatataccgaacttcaagataagtatgactttgttgctgggcaaaatgattctgaaaaatatgaacataatgtgaaatatcaattacgcgaataccttggtatcaagagatttttgactgataaaggttattcggctttcaccactaattttgaagacttagttggccttgaacaattgcctggtttggcagcacagcttttgatggcagatggatttggatttgccggtgaaggggactggaagacggcagccttaacacgtttgttaaaaattgtgtcacataatcaagcgacagcatttatggaagactacactttggatttgagacaaggtcacgaagcaattctcggatcacatatgctcgaagtggatccaacgatagcatcagataaaccacgtgttgaggtgcatcctcttggaattggtggtaaagaagatcccgctcgtttggtctttagtggacgtactggtgatgctgttgatgtgacaatttctgattttggtgatgagtttaagctaattagctatgatgtcacaggaaataaaccagaagctgaaacaccatatctaccagttgctaagcaattatggacaccaaaggctggtttgaaagcgggtgcagaaggttggttaacagtaggtggcggacatcacacaacattgagtttctctgttgattctgaacagctgacagatttggccaacttattcggtgtcacatatgtagatattaagtaaagggcataatcatggaaaatggatctacaaaaagaatcgccagttcatttatatatttctttggtgcatttggcggcattttatttggttacgatattggcgttatgactggcgctttaccatttttacaaaaagactggcatctaacagatgcagggactatcggttggatcacttcaacccttatgttaggagcaattcttggcggagcattagctggacaactgtcagatagattaggtcgtcgtcgaatgatactggcttcatcatttatctttgcagttggtgcaattatggctggtgtttctccaaataatggggtggtgtggttactaattgctcgcttcctcttgggcttagcagttggtgcagcttcggcattagtaccttcatatatgtccgaaatggcacctgccaaaaatagaggtcggttatctgggttgaatcagctgatgattgtttctggaatgcttttatcatatatcgttgactatttgctacaaggcttgccgcatacgattgcttggcgattaatgcttggattagcagctgtgccggcaatcatacttttctttggtgttcttcgtttacctgagtcaccacgatttttagtgaaaacgcacaaattagccgaagcacgacaagtgttaacttatattcgtactgccagtgaagtggatccagagctagaagacatacaaaatactgtagcaattgagtccggtgcgcaaaaaaatattactttaagtacattattttccagtaagtatcgatatttagtcaccgcgggtattggtgtggcagctttccaacagtttatgggtgccaacgcaatattttactacattccgttgattgttgaaaaagcaagtggacaagctgcgtcaagcgcattactatggccaatcgtacaaggtgtgatacttgtcctaggcgcgttgttgtatatggtaatagcagacaagttcaaacggcgtacgctactgatggtcggtggaaccgtaatggcattgtcattcttaatgccatcagcactcaatgcattggtgggtgcagacaagtttccacctatgctgatagtggtatttctgtcagtatttgttgctttctattcattcacttgggcaccactcacctgggtattagttggtgaggtatttccgttagcaattcgcggtcgtgctagtggattggcatcgtcatttaattggcttggttcctttgctgtagggttattatttcctatcatgacggctgccatgccgcaagcaacggtatttgctatctttggtgtaatttcaatcatcgccgtcttatttattaagtttgccgtacccgaaactcatggcagaacgcttgaagaaatagaagcgcaaggaacaaaccattaaagagtattcgatagataaactggttcagttgaaatagggaaatcgcagagcgggcatcttgtactggttggcgtttttccataaaggagagcatatttatggcagacgaaaaaataaaacaagcgattaaaaatggtgaagttgcacttggtgttgaatttggttcgacgacggtaaaggcaatcttaacaactgaagatttcaaaacaattgcttcaggtagctatgaatgggataacagtttgcaagatgggctgtggacatatgcgatagatgatatttggctgggattgcaaacagcttatagcaatcttagaaagaaagtatttgtcgattacaatgttgagataaaaaaaatcaaaaccatgggattttcagcgatgatgcatggttatctagcatttgataaaaacaatgaattattggttccttttcgtacatggcgtaatgccatcactgaagaggcatcgctagaattgacaaaattatttgaatttaatattccacaacgttggagtgttgcccatctttatcaagctattttgaaccaagagacccatgtcaaaaacattgaatttttaacaaccttggcaggctacgttcattggcaattaactgatcaaaaagttataggtatcggggacgcttctggaatgttcccaattgatgagaaaactgggagctacagtcagcgcatgctgagccagtttgattctttgaagtctgtccaacaatataattggcacattcaagacttactaccaaagccattaacagctggtgaggttggtgggtacttaacagagaaaggggcgaggttacttgaccctagtggcaatttatcagcaggagcaactattgcacctccggaaggagatgcaggaacgggtatggtgtcaactaacagtgttaaaaaacgttctggaaatatttcagtaggtacatcaattttttctatgattgtactagaaaaaagtttacagcacgtttatacaaatattgatatagttacaacgcctaccggctcgccagtagcaatggttcatgccaataactcagcatctgatttgagtgcgtgggtcaaactattttcgcaattttctaagatgattggcagtaatatttctaccagtgaattataccaagcactttttaataccgcattgacggaagcagaaccagatgctggtggtctgtctggttacggttattattctggtgagaatattaccgcggtcccagaaggacggccattattagtgcgacaaccagattctgaattcactattggtaatttgatgagatttcattttttcacagcatttggtgctattaaaatcggtatgcgtattctatctgacgaaaaagttttgacagacaatatcgtggcgcaaggaggtgtcttcaaaacgcccattgtggcacaaaaattattagccgcagcactaaataccgatattaccgtaatgaaaacagcaggtgaaggtggcccatggggaatggccgtgttgtctttgtacacgataaataaaaaaacaactcaaactttggatgattttttggataataatgtgtttatcaatgaaaaatacgaaaccttatctcctgaacctgaagatgttcaaggatttgaacagtttatggagcgatatgtcgcagggctagatattgaattgacagcgattaaaacattgccatcaaaaaaagagaaggagtaaacgttatgttagaagatttgaaaaaagaagtttacgaagctaacatggctttgccagctaataatttagtgaccttaacttggggaaatgtttcccaagttgatcgcgagaaaggggtttttgtaattaagcctagtggtgttgattataatgacctcaatcctgaagacatggtggttgttagtttagatgggcatgttgtggaaggaaatttgaatccttctacagataccccaacccatgcatttttgtaccgacattggactgatttgggtggaatcgttcacacccattcaaaatgggctgttgcctttgctcaagcaggaataccagttcctgctgctggaacaacccatgcggacacattttatggggatgttccagtcgctcggcgtttgactaaaaatgaagtagatagtgagtacgaactaaatactgggaaatcaattgtacgcgcgtttgaaagtgaagatattgatcccacggcagttccgggtgttttgacgaatgatcatggaccatttacatgggggaaagatgctatggatgcggttcataatgctatagttttggatgttgtagctgaaattgattatcatactatgagccttaatccttcgcaagatattcacgtaccacaatatttgttagaccgtcattactatagaaaacacggtgtaaacgcatattacggacaaaatactcattgaaatataatttattaagatagttaaagttaataaaaaagagtccttttttaagagctcttttaatgcaattacccttctaaaaactataggcaaaatttttgtaaccgctctctactaatgatatagtaggcataacaaacaaagtgtttgttaaacaatatacacgttattagtgcgtgtcaagattgtgctgagtattgtatgaaaaagggaggaattatatgacaaacataaatggagaatatgcaaagcagaattttccaaaacagagtcaacctgaaccaggattacaaagcaagatgtcgccaacaccagatgatggtgcagcaagttacgttgggcatgaccgcctgaaacataagaaagcactgataaccggtggtgactcaggaatcggcagatctgtggcgatagcgtatgcgcatgaaggtgctgatattgtgttaaattatcttcctgaagaagaaccagatgcacaagaagttaagggcattattgaatcattgggtcgtaaaatcaagctagttccaggtgatttaaagaatgaagcattcagccaaaagttgattgatgaagcagtttcattttttggtgatttaagtattttgacgttagtagctggcaaacaacaagcggaagttgatatagctaatttgtcgacacaacaaataaccgacacttatgcaacaaatgtttttagtctcatttggcttgttaaagcggctttaccacatatgcaacctggcagcagtatcataacaacgaattctattcaggcagagcaaccatcgtcatttctcgtggattatgcaggtacaaaagctgctatcaagaatatgacgatgagtttggctaaacaattggctaatcgagggattcgcgtgaatagtgtggcacctggtcccatttggacacctttgcagattgttggtggacagttaccggagaacattccaacatttggccaatcgacacccatcggtagagctggtcaaccggcagaattagcaggcgcttatgttttcctagcatcaaatgaatctagctatgtaacaggtgagtcaatcaatgttactggtggcttaaagtaaatcatgagctcctttgaatttcgtagatactaatcagaaatttggttggatcaacgaagaaagtggagaaaagatggataaaaagaataaaaaatttggcttttgggataaactgtcaatgcttttggcgttgtctcaattattgttcagtttctattattttgtcagaaattggaagaaaacaaaagaagattaacaaattttcattttaggcataaaggaggaaaactatgttcaaaactgtacttaaggtattgttggcatctacattaattctaggcggtatagcagttggagggaccatatttgcagctaaaggcatcgacaaagctggggaccgtttggaagaggaaatccataattaaatcattaaacagataataacgatagcaacttattgatgaggagctgttgtttttttaatctttacaaaacaactcataatttcattgttttgtaaagggggtaagcgttatttttgtaaacgctttccgttagtgttatatttaggctagtgaattggatatcataattcatagagaagagaatggaggaaagattatgatttggtcattaattgtaggtgccattattggtgccattgcaggtgctatcacaaatcgtggtgagtcaatggggtggattagcaatattattgctggtctaatcggatcggctattggccaggctttgttgggtcaatggggacctagcttggcgggaatggcaatcattccttcgataattggtgctgtgattcttgtactagtcgtgtcaatggtgcttggtatgagagcaaaacagtagcataaggtaatagagaggtatgatatgaagaaaagtcaaaaaattgttctgagtattttcagcctcggatatttggttgggctttgcttgttgatatggccaaaaataattgatgaagtgttcaaatttttagcagagtttaatatacatttagactttaagagcgaccttttcatttattactatggtcttgtactgctggcactgaccgtgcttgtgtttttactcatattgatatggccggtagaattaccagatattcctttgaagcaaaccaaagagggacggcttgcgttgagtaatcatggtatcaaccagtttattcagacaaagctctcaggtgaagatttatcaaatattaaagtgagattgaaaaatactcgtcgtcaacgaaaattttatattgttgctgattcagtttataaacaggcgacagtcgaagaattacctcgtatttcatacgatttaacgaaaagcttgaatgatttactcgctggcataaatcgaattcccattaaagttgatattaaagtaaatcagaaatcaaactcaaagcgtaaagtcacacgtgtgatttaaaaaggagtgcggatataatgaaagacaaaaaatcaattaatatttgggttggtggtcttgcgggtttcattctgtcaactctattggtaactgtaggattttggaagacgattttgattatagttgtcaccttactagcaggttggattggctacttgctcgaagcttataatgtcgatttatcaattgtctctaaaatatttacacgtaaaaattaattatttagatatagaaaggatttaattatgtctacagaaaaaacaactacacaaaatactgcaacagagaatcgtcaacctaaaggtgaattaacatttgatgacaaagtgattcaaaaagtagtgggctatgcaattgaaaacgtgacaggattgctaggtgttgatggtggttttgtcgcaaacattaaaaataaaattgtgaatacggataaccccactgatggcattggtgtcgaggtcggaaaagaacaagttgcggtagatttagatattatcatggaatatggacacaacgcacatgatatttatcagcaactaacagaagtaatcacaaaacaggtgcgagaaacaacaagtttgacgctagttgagttaaatgttgaagtagttgatattcaaacacaaaaagaatttgatgaatcacaaacaagcctacaggatcgcgtaacagacgctggtagcacaatcaaagaaaaaacttcagatggcgttgatgccgtgaaaaaaacaacttctcaagcagtgaacgatgacgataatcgtgtcaagtaaacgtaaaagcggtttgaagttgcagtagcaagtctcagcacagcggtctaaacgttgtgctttttatattagaactaggttgatgtaagctatgaagcgaataaaaattcaaaaatttttgcataaacacgggaatgttttcttgcttgccttgactagtggtaccttagtagctttgctaacttctttgactgcgtcttgggaatacattctcctaacaggatgggactgcgctatattcgtacttttttgtttagtaatttactctttttatccgatggatcaaggccggcacacgaagaaagtaattctcaaagaaggtattcgatatccactgattgatgcgtttgttgtcttttcaagtgcagtgagtgtgtttattgtgattttgttattaactatcagcaaaggcagtcgcctggaaattgtattttgtatttttagtgttttttcttcttggaatttgattcaattattgtacgctattcattacacggaaatttattaccaaaataatggtggtgtgtcatttaatgcaaagggtcttcctaatttctgggattttttgtatttagcctataccattggtatgacttaccaagtttcggatacaaatttttctacaacccgttttcgaaaagttgcattagggcactcactcatttcttttgcctttagtacactcctcattgccactatgattaattttatagccagtttgattagtagtcactaagccctttttagaatcaaacgtgataaaagtgcaagctaaatatttgcggaaaaaatatgacagtggtaatctggacttaggttctgatagagaaccagaaggagagatatcattatgggattaatttggacacttatcgtaggtgcagttatcggtgctattgcaggagcaattacaagccgcggtgcagctatgggatggattagtaacatcattgctggtttaattgggtcttggttaggtgaaagccttcttggatcatggggaccaagcttagcaggaatggcacttattccttcaattattggtgcagttgtattagtcttaatcgtatcttggattactagtcgcacaaataagtaatttataaaaactcactgcgtaaaactataattaactgttttacacagaaagtaggtataggagaaacttatcatgacagaaaacaaaaataaagaccaaaataaagaagagcaggttaaggatcaaaaggaaaagattgatcctgagtcaactgccgaaaatactaatctttatgaacatgatccaaaaaacgctgattataaaaaagctgattaaggattacattagtattgccactaaagcttaaatttgttagttaacaagttaggcttttttataaacccttttgcagtagaataggagacatttttaatgagtttgaatgagttatatgaactaaatgatgggcatcagttaccaaaaattggcttgggaacctttcagattcgaggttatcaaggcgttgaccagattttaaatgctatacaaatcggttaccgattgcttgatacgtctacaaattatgacagtgaaggtgcggttggagaagctattcgtcgttcaggtatcccacgctcgcaattttatgtaacaacaaaacttcctggtaaatatcatcatttcgacgatgctctgaaaatcattgaagaatcattgcttcgtttaggattagactatttggatctttatttgattcattggccacttcctaaacgagacaattatgtggaggcttggcaagcattaattgaggcacaaaggcgtggactagttcgttcaattggtgtgtccaactttgaaaaggaacatctggataagattatttcagcaacgggggtcacaccggctgttaaccaaaatgaaattcatccatattggccgcaggaatcattggtgtctactaatcaagagtatggtatcgtaactgaggcttggagcccattaggtcgaggcagtagcgaattaacagaaccgttaattttaaaactagccgaaaaatatgataaaaatgcgggtcaaattattttgagatggcatatacaacgtggtattttaccagttgctaaagctaccactcctcagcatcagcgacgtaacttagatatctttgatttcacactgacagagactgaggttagccaaatatctgatttggaacgtaaagatgggcgtgtggatgaccaagatccaaaagaatacgaagaatttgtttaagtgatttatggttttctcacttttaaaatttttacaaaggaatattgaaaagtatgaaaactaaatcaaaaaaagttaagctgaattttctgcattactgtgtttacgttatatcattaggcggatttctatttggctatgatactggtgtgattaacggtgcactggcattcatgagccgtccggaccaactgaatttgacaccgaccttacaaggcgttgtgtccagttcattggttattggtgcttgttttggggcactgggatgtggtcgagttgctgataaaattggtcgccgtaaaacgctacgaatcattgcaatcgtatttacaatagctacggtgctttgcgctgttgccatgaacttttggcttatgtcactttttcgatttgtattaggtttagcagttggtgctgcatcaagtttgtcaccaatgtatttagcagaaatttcaccggaaaatttaagaagcgccaatgtcaacaaaaacgctatttttattgtacttggtcagttatgtgctttcattgtaaatgcaatattaggcaacatctggggccattggggtccaatttggcgtgttatggtgatttctggtgcggttccatcaattattctgtgggtaaactcgtttcgtatcagcggtagtccgcaatggttacttttaaagcatcgttttaaccgagctcgaaaaatatttcgtcgattgggatttaaaaatactaaccagcttatcaaatctcaaagtgatcaatctagtgagcaaaacgataatgaatttaattggtcaatagcattaaaaaacaaaaaattgttttatttgttagtgacaggaattgtgattgctctgattcagcaaatctcaggtgtaaacaccgtgatgtattacggtacaattttacttgaaaaagttggtatgggtgaaagtggctccttgtacgccaatgtgttaattggtgtcgtttctgttattgctagtatatttggtactcgaatgatagaacatgccaatcatcatcgcatgttgattattggtctgattggtaacgttgtttttatggcgctacttggaactattatgaaatctagtgttttttctcaaggaataactaatgctttggtgcttgtcagtttaacgttgtttttggctaatcatcaaggtattgtaagtcctgttacatggctcttgttagccgaaatgtttcctggaaaggttaaggcgcaatttatgtccgtggctacagcaacaacttggataaccaacttcgtcattagtttaatctatccccagttagttgctattcttggaacagcattggtatttttcgtttttgctatgtcaaatggattaagtattgtgttagcaagtctgtttgtcaatagtaaaaaaatggcaaaggcttatgatacagctagtctatcatagcctccaaaaaggagtgtagttaatggctaatttttacattgatacgacagaagtcgttcatgaaattccacaaaatgatcgtccaaaattttatatgtttggtgtaccacgttatacaaatatgggtgatcaggcagtatcattggctgaaagaaaatatattgagaacgaatttccaaattatcagtatattgaaattattgaggaagacggtgatgaggcgatacctgttgtccaagagaatttgcgtaaagatgatgttattgcgtttactggtggtggcaatatgggtaatttgtatcacaaccacgaagaggcaaggcgtaaagtattttcgacatttgttgacaaccttacgatctcatttccccaatcaattcattttgaggataatgaggatggtgagattgaaaaaagaaaaagtcaggaagcctatagcaagaacccaaatcttgttcttgtagctcgcgacgcacaaagctttcatcgtatgcttacgacttttgacaataaagttattttcacgccggacatggtattatacatgaattcggtggactggaaatttgaacgtaatggggctttgtttgttttgcgtcatgattcagagaaggttgtcaaacaaaccaccattgataaaataaaagaaatactcggtggggacagaccagtggaacgtgttgataccgtattagatgaaccaaaagagattacgccgatcacacgtgacaccttgtttgagcaacagctggagttgttttcacaccaagaaattattatcacagaccgttggcatgctatggttttctctgtcctcactgggacaccatgcttgctttttggaaatagttatggaaaagggaagcacgcgtactttgattggttagagcatgtgaattggattgattacacagatgaaaccgatatcgatcgaattgaaagtagtttaaaggaactgatgaatcaggaccgtcatgattataatgtgaaaaaagacttccaacaactccatgacattattgaagaaaatatatctaaataataattttaagaacttagtactttttggggctaggttttttatttgcagttaggtaagtgagggtgagaaaatcctcaagtgtaagcgctaccaataagtggtataattctgatataaatatattttttattcttaaatagaatgaatggttgtattgaaaacaaaaaaggagttgaaagaatgagcacaaaatttaatttatcctttgtacaagggctaaccgttcgtgaaaaagcagaattagtaacggggaaagatttctggtttaccgcggaaaatattgaaaatgatataccaaaaatcatggtaacagatggcccttcaggattgcgaaaacaagcaagtagtgcagacgcactaggcttgaatcaaagtgtggaagccattgcttttccaagttcagcgttgatggctagttcatttaatgtggacatgctttatgaattaggtcaaaatcttggaacagcatctagagctgaaaatgtgtcagttttattggggccaggtattaatattaagcgttctccattggcaggaagaaattttgaatatttttccgaagatccatatctaactggagaactaggaagcgcttatgtgaagggcgtgcaatcgcaaggtgttggcgtgagtgtcaagcactttgcagccaataatcgagaagatcaacgttttacctcgtcctcgaatgttgatgaacgtgctttacgtgagatatacttgctggcttttgaaaagattgtcaaagaggcacatccagcaacgttaatgtgctcttacaacgcgattaatggtgtgctcaattctcaaaattatcgtttgttaaccgaaatactgcgtaatgaatggggatatactggcgtcgttatgtcagattggggagcagtagccgataatattgcttcgctaaaagcaggtttagacttagaaatgcctggaaatggtgcatattcgattgatagaattgtatctgctgtccaaaatggtcagctagaagaatcaaaattggatatctcagtattacgcgtactggcgttggttgaaaagttccgtgttagcgaagatgatagtacggattatgataagaataatcaacatgagtttgctcgaaaagcagcagaggatagcattgttttactaaaaaatgatgacgatgttttaccaattaaacaaactgaacaaattgcattaattggtgaactagcccagaatccaagatatcaaggtggcggtagttcacatgtaaatgcatacaaagttgttacgccacatgaggttgcaagcaacagtgattacaatgttacttatactgcagggtatagcttatctgaagaaaaaggtaatttagatttagaacagcaagcagaatctattgctgagttgagtgacaaaatcattttctttgctggtgttccagaacaagatgagtcagaaggatttgacaaaaaaaccattgatttgccggaaaatcaagtcaatttgattcaaaagctatcagcaattaatcctaatataattgttgttcttcaaaatggatcagcggttgcaacaccttggagaaataaggtaaaagcaattgtagaaacttatttagccggcgaagctgtcggtgaggcgacatggaatattcttactggtcaaacaaatccgtcaggtaaattagcagaaacttttcctgaaaaaattgaagacacaccggcatacggtacgttcaatgctagtgtagatgaagaaaattaccatgaaggaatatttgttggttatcggcattatgatttaaagaggaaagaggttgcgtttccatttggacatggattaagctatacagattttaagtatgaagatttggaaatagtagctaatacgaaaaagcatgtcacgggtaaaatcaaaataaccaatgtgggctcaatatatggcaaagaaacagctcaaatctatattcaaaatctagaaagccgtgttgagaaacctcgtcaagaattaaaagcatttgttaaagtcggactcaatccaggagaaagtaaaactgtcgaatttttcttagatcggagaagttttgcttggtataacgtgaaaaaaagtatctggcaagttgatcaaggtgactataatctaaaaataggtagttcttcgcgcgatattagattagaaaaaacggtttctttagagatgggcacgacaaataatcgtccgatcagcggagacacttatattagcgaaatcattaaccgagatggtttacatgaatcactcgtggcgtctggtttacaaacagcgattgaaagtattagttcgtctgatagtaatcgagagctaatggaaaacttgccactgcgggcaattattatgatcggagcaaatgtagatcaagtgaacaagttcattgaactagcaaataattgatctactcgtttgtaaatttcattgaaaatggttactcaaagatggctaggttagtgtacaaacagatataaatagatgcttgcaaactactcaatttcattgtatacttacttttagtaattagaaagaaggtcacataaatgacaaaatatggtgttgttgttggttcgattcgtgaaaactcattttcaaagggagtagctgatgcacttgttgctggtctgcctgaagatgctgaggtaaattacttaaatatcagtaacttaccactttacaatcaagattttgatgctgattcgcctgaagaatatacaaagttccgcgcggcagttgctgagcaagatgcatttatctttgtcacacctgagcataaccgaagcatttcagcagctttgaaaaatgccttagatgttgcttctcgaccttggggtgaaaacgcatgggctggcaaaccagcgctagtcgcttcacagtcagtttctggtatttctggtgtattggctcatcacgtgctacgtcaatctttggtattcttggatatgccaactttacaacaaccagaattgtatattggcaatgttcaaaacttagccgatgaaaatggtcatattactaacacagatacgcaaaatttccttgcaaatgcagcaaagcaatttgttacattcgcacaaaagttttaattaagaatataaaaaaacctgactttagaaataagtcaggtttttttatgcgcctttaaatgcgattaaaattaaaatgagggtataataaagatagaggacttaaataatatggataaaaaccagtttaaaaagggaaacgatgatccagtctcagaagacaaagaattcaattcatttttttctgaagtactgcaacgatttcctgacaaaacctcaaagattatacagaattcatatgaaaaatcgaaatccagggcggacaagatattttttaaaagtcgatcgaatcttgatcaagtttttgatacctttttgacgggagttgatcaacaaacagctcagaagtgtcatcgaattattcacgctgcatcattgagtgctgcaattgtgggctgctcgccaattccgttctcagatgcgtttttactagtaccaattcaactaactatgatgtcacgattgcataaattgtttgggcaatcatggtcagaaggtttaggtaaaagtttatctaaggaactggtagttgtaggtcttggtcgtagcgcagtggggaatattattaaatttataccagctgtgggaactgtatccggtgctgtaatcaatgcttccgtagctgtttcaatcaccgaggctttgggatgggtgacagtgaaaatgttaaatgatggtgaggacatatttgaacaagctatgtcatttcgagggcagtttgaaatcctctttaaagcacttagaaaagtgaaaaaataattttaaaaagcatatctcatgaggatatgcttttttataattatttgacattaattaagaaacattataaactattttggttacgtattaattgctagggggaagcattgaacatggggaaattaaaaatagttttaaagtatttggtatatgcatttttactcagttttgtattggatatcggcggattttttagcggaatatatgctgagcgtagcggtttatccgaggaatggcttgaaaatagtcaggtagccatagttttcatgttgattagtcaaattactttaccaatttttttgatgtttcaatataaaagtcggaaaaatgatcttagaattataatgccctttgctaaagataaaaaggtatacagatatttgatagggtacgctgcaggggcaatattctttgtactaacttggataatagcagttgcctttggaggatttcaagtcattaatatttggcatataggtaatgtgctgtggctcgttctctttcttttaggtttttgtattcaaggcatgggcgaagaaatattagttagaggctatttgttaggtaaattaagtcaacatttaagccgtgcttcagctattataattagctcgctttttttcgctgcgctacatttggcaaacccaggaataactagagtagctttcttagaactatttttgtttggtgctatcatggctatgattcgaattgaaaccgaagatttgtgggtggtgggtgcctttcatggtgcgtggaacttttttcaagggccaattcttggtgttgcagtttctggtaccaacagcggtgcgctaattttcaaatcaattccaacacaagcttatgaatggttaaatggtgggcgttttggcatcgaagggagtgtaatgagcctaacgttacatgttgcgttatttggtgcaatcgcagtttggattaaattaaacaagaacaaatcaaaaattatttgcgaatctactaaataatttctttttattttgacctaatggttgattatttttttggtctaaatagggtaatttggaaaaattcgtctgaatcgtcattatctaggatatgttcgattgaaacggtatcgatttcagcatggatttgcagttgttttgagtttagcacttttaaggttgataatattgcttgctgattgtgtatttgtcccactgtgatatggggtgtatatggaaactcagggcgtagaaagggtgagaacaaaggggattgatataaaacatcatgcatcttttgaatgaccgaacacccctcgtcaacaggtagccaaagataacttttctcatcagacgaaaaattttcaaaggtcactttgaaagccgagaatggttttaaaatcgtttgaatattttggataatgacttcgtctgtagcctcactttcaaatggaaacacaagagttatgtgtggacgaatatgtggatataagggatcaagttcgcgcctaatattttggattgttgttatttctgaaagtttaggaaatattaaaatagaacgtaacataaaccttgcctccttaaataaatttaacttgtgtttgtagtatatcaaaatttaatgtacacagtcttcataagaaacaaaaagttatcaatatattatatattgataactttttgtttctatatgttaaaatttacttatttattgattaaagtcaaaacaatatcatctttatcgactttactaccaattggttttacaatgttgaattcagaaaggacattagaatttgttattgtcacaataacggtgtcatcaaagccagcatcctttattgacttgtcccagaactcaatgagtagatcacctttcttaacatgttggccgcgctcgaagtaagtaacaaaacctgtcccttgcatagcaacagtaccaataccaatgtgaattaacgtgactagaccagtgtctgaaacaaggccaatggcatgtttcgttgagaaggcaacgcgaacggttgcatcaaacggcgcataaacccgaccatcgctcggacgaattgcaaatccttgacctagagatcctgaagcaaatgcatggtcattaacggatgagagattaattaattcaccggcaataggcgcattgtatgtgtactcaccagtttttaattcaggcgtggttgtagtcgttgttgtgtcaacaaatttctttccccatgttttttcaagttggtcaacaatttcagcgtgcttgcgctcagtaagtgttactttgcgataaaatacgtaggtgccgattaaaataataacaattggcaaaccaaacataatggttttgaaaatggattgtccggaccctgttactgaagaagctgtagcaccagttgtcattccagcgactacggcagttaatccgacgacgccgtttgaaatagcaccagctagtttatctaatagtggacgaactgacaacgttaatgattcatcacgatgcccgagcttcagttgaccgtactccacagaatcagagattgtcatgagaaccactaagaacacaagtggttgtggaatggcaaataattcagcagcgattagaaccattgtgagtgactgtcctgcaaaaataaacagaactaatccgataatcatggttaagatacaccagaaaaataaattacgtcgattaagtttatcagctaattttggaaatagtgaaacagatagtaagccagtcacaatgtttagtgaggcgaaaattgagaaagcagatgagtttcctaaaataaaagtgaaataatataactctagtgaattaacaagagtgacgcccgtggtgtaaaaaccataagacaaggcaatccacatgagctgatcattatgcgttagaatatggataacatttttgaatgttgttttttctttgttcttacgtaggtcggaatcaacttctttagtaccaacaccaacagcgaccgcactcagccatgcgattaccgcaataataacagcaaaccagaaccaaccacgagtgtcaccagtaccatcattttgattcaaagagaaaaacaaaacaatgggcataacaacaacgccgactaagtttccaccgatagtagaaccgatacgggcaaaagttgcagttttttcacgttcgcgtgagtcaaaagttaatgccggtatcattgaccagaacccaatatctttaaatgaatagaagatatccataataatatagattatgccaaagataatcaaataaagaagtgggtttgatttatttagaccgcccatatttgtgaaaagaatgatcagagcaactgatccaaccgttccaccaacaaccacccaaggtttaaatttaccccatcgagtgcttgtattatcaattgcattaccaataaatggatcaattgctaattcaacaaatcgtagtagaaagataattagcgtaatggaactaatcattttgtcattttgcgcggcattaccactattgaacaaatgtgtggtaacaaacataatgaaatacgttgataatgtcgcaaaaaacatatcattaccgaatgcaccaaaagcgtatgaaacgcgtgatgtcattgactgctggttagacttcataattgtaatctcctttttgtagtagctaacatctcaatagtaagcgctttcatttaaaaaatcaatactttttagtaaatatttagtaaataggtattttttatattttgatgtaaaatgataaggagtataaataaagcaaatgaacttgcataaattgaggaagaaaatatggtaacaattaagcagatagcgctggaaacggatgtgtcatcaagcacggtatctcgagttttaaataatgacctgactctgtcagtttctgacgaaactcgccgaaagattattgatgccgcgcaaaggttgaattacacaaaaaaacataaaaaaagtatttccaaaaaattgatccatattgcagtattgacggtcttttctgaaatccgagaagctagcgatgcttattggcgacaaatatacttgagtattgagcaaaatgcgcaagatcaaaatattattgttgatgaaattattcgaattaatcaaggcattaatatcgcggatttcgcaacttacgatgccattattattttaggcgatatgactcaaaaagcggtgaaccaattgcagaaaattaatgagcgaattgtgttggttgatgccaaaacgcgctatgaaaccattgactctgtcaatcccgaactgcggttgatgacaactcggatattggatgagttttatcaagctggacggcgacatattggatttattggtggcgtgaacgatttgctagaattagatggctcctcaacacttgctgttgaagatgtgcgtagtgaaatctatcgtaattgggctgaagagcatcaaatgagccctcatttttacaccggtccgtggcatgctgaaacgggcatgcaaggcgctatatcgttattaagagaagaacacagtatagatgcactattagttgcttcggatcctattgcaattggtgccattaatgcattgaaatccgagaatctagagccaggaattgatattgatgtggtgagctttgataatgttgagttatcctcttacttggttccggcactaacgacggtagatctaaatcccgcggcactagggaagacggctttagaacaagcctacgaattagcgaatgatgaacgtgattggacagtttgggctacaataccgggaaatttgaaatatcgagaaacttttaaaaagtaaaagtaaccgtttacattttagtaaacgagtggtaaactgtgtttgtaatttagtaaaagacttcacggaggaagattatggctaatgcaaacatttcttttgatgacgagcaaaatgtttttcatctttcaaatcgacaaatatcttacctgatacaaattgaagagggcggactgctaagccatctctattttggtaaaaaaattacaaaatatcatggttcacgacattatccacgtctagatagaggattctcaccaaacttagctggagaaccacatcaaacagatcgtagctattcgaaggacacattattacaagaatacggtggttataatacgggagattttcgtcaagccgcgattaaaattcaaggagccaacggtgcacaagcatctgattttcgttttcaatcattcaaaatcgtaaatggcaagccacatctagatcgtctgcctcaggcctacgtgttatctgaagatgaagctaaaacattaataattaatcttgtggatagtacgctaaatgcccaagtatcactttattacacaatttataatgaccggccagtagttgcaagatcaactaaaataacgaatctctctcaacaaagtattaatattgagaaaattgcatcactgcaattagatttaccagcaagtgatctagaaatcatctcgttacccggcgcccatgtgcgtgaacgtcaaatggagcgacaaactgtgcgccaaggagtggctgaattttctagtcatcgaggaacaagctcgcaccacatgaatccatttgtagcgctagtaacaccgaacacaaccgaaaatgagggtgaagctgttggtatccaactggtttattcgggaaatcatcaattcactatcgaaagagattatgtggaacagacacgtgttctatctggtattaacgaagatggatttgattggcaattaaacgctgatgatgactttcagacacctgaagcgttgttggtttattctgatgacggtttaaatggtatgtcacaagcttaccatcacttgctacgagaacgtgtggctcgtggaaaatatcaatatgcagagagaccaattgttattaataactgggaagcaacttattttgattttaatgcaaaaaaaattcaagagatattagatgaagcatccccattaggcattgaaatgtttgtcttagatgatggttggtttggaaaacgtgatgatgatgatagttctttgggtgactggtttgaatacgctactaaattacagagtggcggtggtttagttggcttgtcagataaagtacacgaaaaaggtatgaaatttggattatggtttgaaccggaaatgatttccaaaaattctgatctctatcgacaacatcctgattatattctcggtatgcctaaccgtgatttgacccctagtcgtgatcaatatgtgcttgatttttcaagacctgaggtagtggataatattttccaacaagtagtaaatatcttggataatgttaagattgattacattaagtgggacatgaaccgtcatttaacagaagtatattctgcagcgttgtcaccagaacgtcaaggagaagtgggacatcgttatatgttaggtgtgtatgatttggcggatcgtttgaccaaacgttatccagatattttatttgaaggatgctctggcggtggcggacgatttgacgctggcatgttatatttctttccacaatcgtggacatcagacaatacggaccctgttgagcgcttaaaaattcaatatgggacgacattaagctacccagtctctagtatgaccgcgcatgtttcagcatcgcctaatcatcaaactgggcgtcaaacgagtctggctatgcgtggggatgttgctactgcaggagtctttggatatgaattaaacctagctaagttgtcattagaagaaaaatcagaaatcaaagatcaagtgacattttataaacagcatcgctcgttgatccagtatggcaatttctaccgtatcaaaagtccttttaaaaataatgaaacagcctgggaatttatcagtgaagataagacagaagcattgttattcaattaccgtgttttgtcaactgcgcagccagttttcactgtaactaaaatgagtcacctgaaatctgacggaatctatgttgatcaaagaacaaatgaacattattctggagatgaactcatgtcaattggtctatataacacgccaattaagcaagctgattttacctctgcggtgcgttatttcaaatggcaagctgaataagtgaaaatcattgtgaaaggaaaaatggaaatgactgaaatatacgaagaattaattcatgtttttaagaagcaatttcatcatgaaccaactgacaagtttttctcaccaggtcgaattaacttaatcggtgagcatactgattataatggtggtcacgtgtttccagcatcaattacactgggaacatatggcgtagcatctcaaagagcggatagtttggtaaaactctattcgactaatttcccggatgaaggggtgattagttttgacgttaatgacgaagaaaagttacctggatcatcttggggaaattttgttaaaggcgtgttgcaggctttaagaggatatggtaaccgttttgagcatggatttgaattagttatcaatggtaacataccaaacggctcaggattatcatcatcgtcatctttagaactcttaattggcgtagtggcgcaaaagctatatgatctaaaaattccgagattgcaattggtggccagtggacaacgtgctgaaaacgattttgttggtgttaatactggaataatggatcaatttgctattggatttggtgaagcggaccaagctatctatttagacacgaatacgatgatttacgaaatggtaccaatccatttgggtgattatgttgttgttattatgaatacgaacaaacgaagagagttggctgactcaaaatacaatgagcgtgttcgtgaaactcaagaagcagtctatcaattgcaaaaatatacacctatccaatatctgggcgaattagacgccaaaacttttaataaatatgctgataaattagaaagcaacatacttgtaaaacgtgcccgccatgctgtttatgaaaacgaacgaactaagattgctgtcgaggcattaaaatcaaatgatttggctagctttggtaagttaatgaatgaatcgcatcagtctttaaaggatgactatgcggtaactggaatagaacttgatacgcttgtggaaacagcacaaaccgtcgatggtgtgctcggtgcaaggatgaccggtgcaggatttggtggttgtgcaatcgcactagtacatcaagataatgttgatgatttgaaagcggctgttggggctaaatatgaatctgtagttggctacgatccctcattttatgtagcaaatgttggtgacggagcacactgggtcggtaaagtaggtgaataataatgtcagaaaataatttaattacggaatttactcagcgtattatcgaacaatcggattacacaaatgaagatgcaatctacttgggaaaccaaatattaggcatgattggtgaatcaaattatgagcatgtaacaagtgatcaagatgtttcgaggttatctacgttaacactattggataatttggtagcaattgcagcagataatggcacattacagaatagaaaaatcaatgctgatatactaggggcacaactaatggattattttgtgcctcgtccttcacaggttcgacaaattttttggcaacattacgatcacgccccgcgggaggctactgactatttctttgatttatcgaaaagaagtaactatatcaagacgcgggaaattagccaaaatttatcttacccagttgagaccgagtatggtcaattacaaattacaattaatctctcaaagcctgaaaaagatcctaaggtaattgcagcagcactgaaaaataaaacacaacaacaggaacagtatcctgcatctcagttggcaaaagagaatgaaggctactggggtcgtttagattatgctgctcggtcgaatcatcgtgtcattccagtaactttaggtaatgaaaattggtattttcaatattcaccgtatgcctattttaatgaacatgcaattgtgctatcagaaaatattcgaccaatgcacgttgatcaggaaaacttagctagactgttagaatttgttactaaattcccagattattttattggatccaatgcagatttgccaattgtgggtggttcaatattgtcccacgatcattttcaagcagggcgctatgatttacctatggcaaaagcaacattgaaggaaagctttcagatttcagatgtgaacctgtcggaagcgggggtattaaactggccaatgactgcaattcgcttaattgattcggacagcgataaattactcgcagcggctggtaaagtaatgaaaacatgggaagattatgacgacccaagtttattcattcaagctcatagtcaaacgggtgaaagacatcatacggttacaccaatcgtccgattccgtgaccacaaatatgaagtagaccttgtgttacgagacaataatacgtcgtctgagtttccagacggaatctttcatcctcactcagatgtacaacacataaaaaaagaaaacattgggctaatagaagtaatgggtttggctattttgccaccgcgtttaaaaacagaacttgcagaagtcgaagcatatcttttggggaatacggattctgtggctccaaaacacaagatatgggccgataaactaaaacatgaggaaacttttaatgctgataatgtaacggaagtggtggagcaaagtgttggtcaaatttttaaaagagtccttgaagacgctggcgttttcaaaaattccgaagcaggccaagctggtttgaaaaaatttattgtgcagttaacaactaattgaaaacatgaaaaaaatacaagttattgcttgtattttttcatgttttcaatacatactctgctctgactttgattatcatataaaaaaatgataacattgcattgaattgtacattaaagataatcgggaagggggatagcgtgggtaacaatgaatggattggcatcgacaatgctcatcaaaataatttaaaaaacatttcggtcaaaattccaaaacaccagttaacagtttttacaggtgtatctggttcgggaaagtcaaccttagtttttgacactttagttgcgcagtcaagacgtgaattaaatgatacgttctcgagttatgtgcaacacattttaccaaaatatggtagaccggctgtagataacattactaatttgccaatagcaataccaattgagcaacgaaaaatgtcgggcaacgtcagatcaacagtaggaacgtatactgaaatatacacattcttgcgtttgctgttttctcgaataggacaaccttttgttggatattcagatgccttttctttcaatcatccccaaggcaaatgtgaagtttgtgatggcttaggttttactaaaaaaattaatttaacatatcttgttgattttaatcaatcacttaatgaagatccaattgattttccaacttttggaaatggtgcttggcgttggaaacgttatgcctatagcggcttatttgatttgaataaaaaaataaaggattattctaaagaagaactagatttattgttatacgcaccgcagcaaaaactagcgtctcctcctgaaaaatggccaaaaactgccttatatgagggtttgttaccgagaattaagcgaagtattattaatactgatgaggggaaaaggcatagaaagcaacttgaaaagtttgtatccactgatatttgtccaacttgtcagggctccagattgaatgcaaaggcgctaagttgcaaaattgatgggcataatatcagtgatttagttgcaatgtcattggatgaattacaattattaattcaaaaaataagaaatccactggttcaggatgttaaaacacagattgataaacgcctaaatgctttgattacgattggtttaggctatcttaatttagcgcgaagtacagatacgctatcgggcggcgaagcgcaaagaatcagaattgctaagcatatcacaagctctttaaatgatgtgatgtatgtcctagacgaacctagctcaggcctacatccaaaagatattgaacgactatataaatgtttgcgagtcttaaaggatcaaggcaatacgattattttagtggaacataacccgctgctaattcagcgagctgactacatcattgatgttggtccaggtccgggagttaatggtggcaatgttcaattttcgggaacatacgatgaatttttaaaaagcgatacgattaccagtgttgctatgcgtgaaaatgagaggttgaataatcatactaatagcagcttcaaaaaatggctgtctgttagagataaaaatttaaacacagtacaaaacgtttctttaaaaataccacttaatgctttgactgttttatgcggtgtggctggatcaggtaaatcgtctctagcacaaatagtagcgtcagaattgattcaaagggaaatcgatgttatcaatatttcgcaaaagaacattggtattagtcttagatcaactccactgacttacttagatatttttgatgatattaggaaactatttgcaagagcaaactcagttagtccatcgttatttagttacaattcaaagggcgcttgtccgcgctgcaaggggaaaggcgttatcgttaatgatatgtactttatggacgatgtcgtttctgagtgtgaattgtgtcatggacaacgctataatcaggaagttttgcaatatgactataaggataagactattgttgacatattgtctatgacggtgagtcaagccgttgatttttttagtggtattacacgaatagctactggtttgcaagcaatctgtgatgtgggtcttggttatttaaaattaaaccaatctttgagtacattgtcaggcggagagttgcaacggatcaagttatcgagctacttacaaaagaagagtagtgtttatattattgatgaaccaacgaatgggttacatttaaaagatattgatcatttgctcgagcttttcgataagctggttgctagaggaaacacgattgtcattattgaacacagtttgaaagtcattcgacaggctgatttgctgatagagatgggtcctgaaggcggaaaaatgggtggtaaagttgttttttccggtacaatcgacgatttgaaaaaatcaaatgatgcaataacaaaaccatatttataaaaaagttgcatataaaaagcagaaaaatatgatttatttttctgctttttatatttggctatttattcgataaaaattcttttattgcatcaaatcccaattgtcgattacctgcttgacaatgttgatcaccaccagacgccttgtcaaacataattgatttaacggaagcagcattaattaatttgctatcaatttctactaagcggctactgggaacatattgatcattttcgccagctagtaacagaacatcttgattaataagtggcataatcggttccatattatatttttggaactgttttaatagttcgtaaggcgattgaacgccaacgttttccatacccttattgattttccaatttaaatctagattattggccatcatacttttgaacataagattaactgttttggcatctttagcagctagcagctgttcgattttagtaatttgatcatagggcattcgaatacgtaatgcatcaaagaaactatagaaaatatcaaatgcaacaactttgtccaatcgtttttcaaatgcggcggcgcgcataactaaatatccacctaatgacataccaactgcactagctcttttaaggttgaaataatctaatatgacgcttaccggactttcccaattatgtatcaggtgaatcccttgacgcaacgcagttccttgacctggcccatcaaaaacataaatgttgaaatcaattcctttcaaaaattttgacattttgaccatctcttccatgtaggaatcatatccggcaaatagcaatagattcttagtggcgtttggtgtgactagttttacaactggtagatacccattttcataaggtacttgatacctttcgtattcaaagttgttgaagcctttataaaaattttctcgatactttcgataagcattttcatctcggggatcctcaggtgacaaataaaactcagaggcttgataataagttgatgcgacagagaaatcaccatcttgttctcttgcaatagctttgtcgttccatgctttaaaccatgattcttcatcttttaactgaggaatgatactttttaaatcttcctgtactttttgatcattttcgtactcatcattgatgaatcgattaatttgtaaattgaattgttcatttttaatatactgtttaaacatgttgttcctccttcttttaagtacattttgacatgatgaaggtaaaatacaactggcaaaagcggtaataaggaacgatatcatactgaaaaaagaaaacagtatgatattattggtgtataaataggagggtcagcattgtgtcaaaagacaaaagggttatcaaaacagaaaaattgattactgaaacgatgatgcggttattgacgaccacgagtatttcaaaaatcactgttaagaaaatttgtgatcaagcgttgattagcaaatcaactttttatgatcactatgtcgacaagtttgatgtcattgaaaagattgttgatgtgtatgcgatgcagtttaattgtgaaatccaacaaagatttgaagcagtgcagcagaaaaatacctttgaaatctttaacaaaattatcaaagatatggctaatcaagatagtgatttattaattttaatgtcgcttgaacaggatgtacatcgtgttcaagatcgttttcacaaaatattatacgataatgcccacgctttcttgtcaaaacaaaaaatgaataagcgtttttcagttggcttcttatcccaaatttatgctgaccttgcattaacttcaatttcttttacgttaaaacatgctgagaacgaaaagcttcttgaagagcaaactgattttatgaatttaatgcaagaggtgatcatttctaacgttaagcagtaaataccctttcttaatttatataagttttaataatgtcactaatatgctttacatattagtgacattattttatactactagtatgttaaacatactaatcgagaggatacatcatgaaacaaaatatatccagtcagatgttaaaaggtattcttcaaggaatcatgttaatgattttggcaaaacggccggattatggttacggtattagtaaacaaattaatgaatatggcttagaagatatcccgaaaggaactatttatcctttattaacagccatggaaagacgcggattaattgtagggaaaatggaagtatcagtagatgggccggatcgtaaatattattttgttacatcagaaggagagcaggcaaagcaaaactttatgcaagaatggcattttttaaagcatgctgttgacaagctagtagaggagaataatcaagatgaaaaccagtgaaatgattgaggcaaataatcaattacgagtacagttaaatacaaaaaataaaaatttttatgaaaatatattagtttacattagaattgaagggttaacacgtgatgaaaataaaatggaagtgcaacttctgaacatattacaagatataattgacgcccaaaatgatggcttaactgcagaagaatattttggtaaaaatcctaaagaacttgcggatgaaattttgttggcaatgccatctaatatttgggaaagcgtcaagctagcgttatacattgtggcagcttatataggttcatcttttttgccgtctttaatgactgcaggaacacctttggatgttggcgcacttgtactgtgcgggatatactcaattattagcgttattgtagtattgaagtatgttgcttcaacaatatatacagctaatcgaaaaatgaaaaataagtatgccaagatttttgtattgtggtttacaatcagtttattgtttgcacccttatttatcataaaaacgtttgtacacacaccaattgaaataagcttagatggatggacaggcattatagttattataattaccttaattattggcgctatcttcttttttcgacagaaagataaaactcttggctggccaattgtcatttttttagctggtgcaggaataatgggtattgtcacacgaataccagcttatggtaattcattgctacatacaaaaaatggtcgatatttaatggctggaataacgacaatattgtttattttattttgtctattcaatattatcgcagctagaaaattatcaaagcaaacaaaataaaaaagtactgattgatgtgtaaagttcatatctatcagtacttttttgtcgatataaattgttttggattaatttaaaattaaactatttaaaaatgtggaatagtcggtgcaattccggaatgtcggaagagtactgcgatgcccgtctcaatctttttcatgttaaaatagcgtggacaaaaagtatgatatggcgacaacacaaaatatcgcaaattggtctaagatatttaatacaattaaaatgatggttgaagccggacaagttcaacgctttatttattatatatagtcgaaaatgatttaatctccggattaatacgtgagaaccatgcgcatgttgaagctaccagaactttagggctagttttcagttaaaattattatttttgttaaaatgttagccacttgttgcttttagaacgaagttttcgtgaagcacaagctcatctttctagtcattctaaattgttgacaactgcacttaacggttccgtatcgtataccaaaaataggtgaataataatgacaaatttaaatgatgttgcgcgcaatgcacacgtgtctaaaatgacagttagtcgtgtaattaatcatcccgaacgagtttcagatgaattgaaagagcttgtagagaaagcaattcaggacgttggatatgagccaaatcgcatggcaaaagcgcttgttaacaagcgccattatgtgattagatttttactcttagaggatgtcacaacagttgaaccaaattacgccaagctattgattcatattgctaattatctccaagagagcggctacacgctcgaaataagtaccgatttagccgccagtacaaacaatattgacgggatgattgttagtggctggcgtcaagcggacttagagggtttatcattagtgaccgtaccgattattttgtatggtgtggcaccggaaaattcacgtctttcttatgttgacgttcataataaacaaggaattgagatggcaacgcaatatatgatagacagaggttatcaggatatttggtacattggaattgcaattgatttaccatttgctaagcagcgggcgttaggctatcgttcggtcatgaataagtatggtatgagtcaaaaagtttttgctacagaaaaccatgcccactcggcggatatattgatgacgaatatggtgacaagtattcaatcaaatactggtttcgtctgcgcgacagatcgcattgctttgggtgttgtcagatccttgacacgtatttatgaagtgccaactgactttggagtaattggatttgatggtgtatttattgaccaaatttcctcgccacaattaacgacaattaggcaaccgattgcattaattgcaaagaaattggtcgaggagatagtaaaccgagttgagtctgacgaagaaaataccaaaattgaagttaatattaagccagaactaattatccgcgattcaacgcaatgaaatgatgttaccgctaacatcgggcaaacgcttccaaatatttatcgactgttttatactgttcaatgtaaacggttacaaaaataatattttggaggcagaaataatggatgataagcataaagggcagggattgcctaatttgccgcttagcacaatttggatgttaagttttgggttcttaggtgtgcaaatggctttttccttgcaaagttcacaaatgggaagaattttccaaacattgggtgctgacccaacaaaacttggttttttcttcatattgccacctttggctggactatttgttcaacccttggttggttacttttcagatcgaacatggaccaagcgttttggacgacgcatgccatacttgttagttggtgcattagtttcggttatagtaatgttcctgttaccaaattctggtagctttggattttctacaaccgcagcattatggtttggcgcaataacgattttgtttatggatcttagttcaaatgtggctatgcaaccttttaaaatggttgttggtgatatggttaatgaagatcagaaatcatacgcctattctattcagagtttcttatcaaatacaggttctgtactagccacaatttttcctttcttgttaacagcaattggggttgctaatactgctgacaaaggacaggttccagcttcggttattatttccttttacgttggtgcagttgtattagttgtcttctcattagttgcggtattcaacgtaaaagaatacgatgacgcaacttacgagctttatcatggttacgcattaaacacgccaaatgataatgatggtgggtttttaactttattgaagcgcgcaccaaaaacattttggatggttactgtgacacaattcttctgctggatggctttccagtatttgtggacatacggtacaggtgcagttgcagataatgtctttcatgcaaccgacccaacaacagcaggttatcaaaatggtggaaactggtttggaattttgtcggcggtttatgcaattgctgccgtactctggtcgttagtactctctaaaattccggcagaaaaaaataaatttggctatgctttgtcgcttctattaggggcaacaggattcatttcagttttctttatccattcacaatatcttttaattgcatctttcattttgattggtatttcatgggcagggatgatggcttatccatttatcatggttactaatgcattgaacggcgatcacatgggcacttatctcgggctattcaacggctctatatgcctgccacaaattgtggcgtcagttgcaagttttgttgtatttccagcattaggatcacattttccatcaatgatcttagtttcaggggttttgatgctattgggtgcagttagtgttggttttattaaggaaattcatagtaatccagtgaatgcagattaatatagtaataacgttaccgtaaagaagaaagaggcataaaaataatgaaaagagtttttgaaattaacccttggacagtcgcaacgcacgatttaaatcctgaagacaaacgcctacaggaatctatgacaagtttgggaaacgaatatatgggcatgcgtggtatgtttgaagaggtttattcaggcgatacacaccaaggtatctatattggaggcgtgtggtttccagataaaacaagagttggctggtggaaaaatggttacccactttactttggaaaagctattaatgctttgaattttgtgaaagcagacatttatattgatggccatcaaattgatttagccaagaatgaatttcaggattttgaagtatccttagacatgaaacatggtgttttgaagcgtcgatttacagtctttggcgttgaagttcaagtatcacgtttcgtttcagccgcgtttaaagaactagccgatattcactatacctttacatctgtggatggatataatcataacattcgttttgatgctagcattgatgctgatgtagtcaatgaagatgctaattatgatgaaaaattttggcaagttttagatgccggtaatgatgttgcatcgtcatttattgccacacaaaccattgagaatccatttggtgtaccacaattcacagtggttgctcgtcaaagtttcattggtggcgaaaaacacggcactaatcgtggaacaaaagaagttactgataactttgatattgaggtaccaactaaaggcgtagtaaattttgaaaagcgtgttatcgtaaccacttctcgagattacgatagtttaaaagaaacgatagatgctgggacagcgttgacgaacaaagttttagaaaactcttatcaagaaatatatgaagaccatgcgcaagaatggttgaaacggtgggagaaggctgacgttcaaattgaaggtgatgatgctgcgcaacaaggtattcggttcaatttgttccacctcttctcaacttactatggtaacgacccacggctaaatattggaccaaaaggcttcaccggtgaaaagtatggtggtgcaacgtactgggacacagaagctttcgccattccggtctatctaggtgttgctgatccatcagttacaagatcactattgcaataccgttttgatcaacttgatggtgcctttcataatgctaaacaacaaggcctaaaaggcgcgctttatccaatggtgacttttgatggtattgaatctcataatgagtgggaaataacatttgaagagattcaccgtaattcaactattgcttatgcgatttataattatacaaatattactggagatcactcatggttagacggggatggggcgcaagtactttacagcatcgcacgtttctgggctgatcgtgttcactattcaaaacgcaatgatcagtatatgattcacggtgtcactggacctaatgaatatgaaaataatgttaataataattactacactaattggatggctaaatgggtattacagtattcgcttgatcactatgacgaaattaatgacaagcaaaaggcaaagctagctattaccgatgaagagttggttcaatggcaagatattgttaccaaaatgtatttgccagaagctgatgttgatacaaaaaatggcaaaaaacatatttttgtacaacatgatacatttttggataaagatttaaccccaattgctgatatgccacaagatattcgtccaatcaaccaaaactggtcttgggatcgaatactacggtcgccatacattaagcagtctgacactttgcatgcaatgttctattttcctgatgcctttactgaagaagagaaacgtaacaattttaacttttatgagccactgactgtgcacgaatcatcattatcaccgtcagttcatgcgatattggctgctgatttacaaatggctgacaaagctgttgaaatgtatgaacgcgctgcgcgattggatttggataattacaataatgatactgatgatgggttgcatattactgcgatgaccggttcatggttggcaatcgtgcagggatttgcaggaatgcgagtacgaaatgacgaattacatttaaagccatttttgcctaaaaattggacaaaatacgcgttccgtctggttttccgtggtcatgttttggaagtgacggttgacaaagaaggtgcagatgtccaactaatttctggtgacccacttacgattaatttattgggtaaacaagtcacattaacaagataacaaagaggaggacgaatcaatgcaaaaattcaaagatattaagggatttgcttttgatttagatggggtcattgcagacacagctcgatttcatggacaagcttggcatcagactgctgatgaagtcggcacaacttggacaccacaattggctgaatcactcaaaggtattagtcgcatggaatcattgcaaatgattttagacgctggtaatcatgcggatgatttttcacaagctgataaagaagtactcgctgaaaagaaaaatcatttttatcaacaactaattgcaacattaacggaggaagatattttgccggggatgaaaagttttattcgttcggctaaagtggcagggtacaaaatgtctatcgcctcagcctctaaaaacgcacctatgatccttgagcatttgggattggcaaatgattttgttggaatagtggatccagcaaccctgacaaagggaaaaccagatcctgaaatttttgttagggctgcagaagtgctagaactggcacccaatcaagtcattggattagaagattcagtagccggtatcgagtcaattaatagtgctggtcaaatatcgttggcaattggtgatgcagttgttttatcggctgctaatttaattttcagttcgactgtcgatgttactttgcaaagtattcaatctaaaatggacaaaatcaagtctaattaaaagaaaatcattaaagctactagaaataagctttaatgattttttattgtgctaattatttttattaagcgttgtcactgtgcctgacgggacgattttagtctctgtaaagaaaacagcatgtggcgctaattcctgttcatctagtgccgaaacagccaactgtcccatcaattgaaaatcttgtttggcagcactgagaatgggccgggttatttgtgctatttcagtaccgtcaattgttacgatagataggtctttggggacatctatttgagcgtctttagcaccattgaggatgccaacgctgataatatcggccgaaccaattgctgctgtaaaaggtaatggtgtgccaaaatgtttgatagcatccattccagtttggtaagcattctctgttccccatatgaaatcgggatgatatgcaatgccgtgttttgtaagtgcgtcaataaatccttgtcttcgtaatttggcaactattgaatttggattagaagcaccaatgagcgcgattttttcgtggccattttcgtaaagatagtcaacaatttgatgcatcatatcataattatcagaggaaattgaaggaatttcattgtttaattgattcgaaacgctaagaagttggaccccagtgctggtcaacaagttaaaaacaggatcatcaatatcgatgtccaccgctagcatgacaattgccaatacttttcgagatagtaaagaatgaacgggttgcagctgctgttctttgtttatatcgacaaaggcgatgagtaactcatagttaagtttatatgctttagactgcatacctttaataatctcatcggcaaaattagtatgttcgcttggtactaacacgccaataacgcgactctgtttttgtgatagatcagctgctgattgattcttaagataacccattgactctgcaagttcacgaactctttttgctgtatccgcattaaatcgacctcgattagttaaaattcgagagacggatgccggtgaaagcccagctttatctgcaatgtccttaatagtaatagccatatcaattattataacctaaaaaggttgactttcaatatgaaagcgattacaatgtaaatgcgtaaacgtttacgcacaaaatatttaaaaataataaggacggttatcatggaaaaagtacagtggtggcaaaaggccgttgtttatcagatttatcccagaagttttcaagatagcaatggggatggtgtgggagacatacgcggaattattgaacgattaccttatttgaaagatctgggcgttcaagtaatttggctaagtccaatttatcagtcgccaaatgatgataatggctatgacattagtgattatcgtaaagttttaccggaatttggaacaatggcagatgttcaagaaatgctcgaggtagcacatcatttaggactaaaaattatgatggatttggtcgtcaaccatacttctgatgaacatcaatggtttaaggagagtcgtaaaaacaaggataatccttatcgcaattattacatttggcgtgatcctgtggatgggcatgaacctaataattggttgtcagattttggtggatcagcatgggaatttgacaataatacacaacagtattatttgcatttattctcaaagaagcaaccagatcttaattgggataacctcgatttacgacaaaatatttacgatacaatgaaatggtggttagatcaaggtgttgatgggttccgcatggatgtcattaacctaatttcaaaaccatcagatttaccaaatgatccaaatgtcaccttagaaaatcatggctcatcgatggattttgttgctaatggtccaaatattcatgattatttacaagaaatgaatcaagaagtattgtcaaagcatgatatcatcactgttggtgaaacgccaggcgtatcaacaaaggatgcaatgaaatatgccggatttgattcgcatgagttgcagatgattttccagtttgaacatactgaggttgataatagccatgagggattaggcaaatggagtgatgaacgcttcaagttggttgatttaaaacgtattttatccagatggcaaaatgagttgtatggtaaggcttggaacagtctttattggaataatcatgatcgaccaagagtagtctcacgatttggaaatgattcagatgaatatcgcgtattgtctgctaaaatgttggctgcaactttacattttatgcagggaacaccttatatttaccaaggtgaagaaattggtatgaccaatattgacttaccatctattaaagactaccgagatattgataccttgaatgcatatgatgacttagttgtccaacaaagacgagttactgctgataaaatgatgtcttatgttcatcattcttcaagagacaatgcacgaacaccaatgcaatgggataacactaaaaatgccggatttactgaaagtcacccatggttaagtgttaatcctaattaccagaccatcaatgtggcagattcattaactgatcaacagtcagtctttcatttttaccaaaagctcatcgccttaaggcaagagttatccattatcacgactggaaagtatgaagtgttggatttagaagacgaatctgtttacgcttacaagcggattgacaaagacacgcaattactggttattagcaactttactgatcaaaagcaaacacgtcattacgatcgaacccaatctgcacaattagttataagtaattattcagatgatcaaggtgacacactcagaccttacgaatcaaaagtatatttgttttgattcttttctttcagtaaaatgtaagcggttaccttacactgaatattctagattttatataatcacttaattaaggagagtgaatataatgagtagtaacgaacacaaaaaaggtcagcttccgatgctgactagcctgcaactgtttttaatgacttttggttatgcaggcgtccaggttgccttctcggttcaaacgggtaatatgggaagaatattccagaccttgggttccgatccaacgaaattaggatttttcttcatcttgccccctttggcaggtatgatcacgcaacctttaattggtctgttttctgacaaaacttggttgcctaaattggggcgacgaatgccttatctcattggtggctgtttagtatcattgattgttttactattattgcccaacacaggttcatttggttttggttatggatcaatgacagccttgtggtttggtgcggtaacggtattgttcatggacttgtccgcaaacgtttcaatgcagccttttaagatgattattcctgatatggtcaatgaaaagcaaaccgacaaagcctggagcttacaaaatatatggggaagtttgggtggcgtgattgcctttgttttcccatttatcttaacttcgtttggtgttgctaacactgcagcacgtggggttgtgcctgattcagttaagatttcattttatgttgcagctgcaatactattattatcaaccatttttaccattataaatgtaaaagagtatgacccagaaacgctagcatattaccatggtttcaggtctgatgataagacacatgaatcgtttattgatattttgaaacacgcgccaaaagttttttggaccttaggcattgttgaattctttgtctggtttggtattccatacatgtggacttattctactggtgctctgtcagaaaatatttggcacgtttcagaccctgcatctgctggctaccaagcagcaggtaactggtttggtattttgcaggcagtgtactcggttgttgcaatagtagtgggtattttatttcaaagattaaacgataaaacaagaaaaatgacgtatttcttaagtttgatagctggtggtttaggatttattatcgtagcttatggtcatactcatgtgtcgtcgttaattggatttgtactaatcggtattggttggattgcattgatttcgattccatttactattctgacgaacgcattggatggtaaacatgatggcgtttatctaggtttgtttaattgctttatctgtatccctcaaattgttgcttcggtagcaagttttgctattttcccagctgtcggaaaatcaatggcccacatgttagcaattgcaggcgtctttctgatgattggtggttgtttaatttggattgttaaagaagaaaaaacacaagtagatatgacacaaaaaggagaatgaaaaatgacagaagatattaagtggtggcaaaaagcagttgtttatcaggtttacccacgatcgtttcaagatgcaaatggagatggtattggtgatcttcaaggcatagaacaaagattagattatattaaaaaattgggtgccgatgtcatttggttaaatccaatatatgcttcacctgacaaagataatggctacgatatctctgattatgaagatattaatgcaaaatttggtacaatgcaggactttgatcgattacttcagaaagctcatgataaagggatcaaaattttgatggacttggtcgttaatcacacatcagaccaacaccaatggttcattgaaagccgttcctcaaaggataatgataagcgtgacttttatatttggcgtgatccagttgatggacatgagcccaataattggggttccttcttttcagggccggcatggaaatttgacgaagaaactgggcagtattacttacatttgtttgttgaaggacagcccgatttgaattgggtaaatccggaagtgcgccaggcagtatttgacatgatgaacttttgggttgataagggaattgatggcttccgaatggatgttatttctttgatatcaaaaccagatgggttaccagacggtgaggtacctgaaggaggggagtatggtaattcagataaggcagtagctaatgggccccatgttcacgagtatctgcaagaaatgcgtgaaaaagtgctaaagagagctgatatgatgactgttggtgaagcatctggtgttgatatcaataacgctatcaagtatgcaaacacaaatgaatcagaattaaatatggttttccagtttgaacatatgggacttgataataatccaaatccagctttgggaaaatggtatgatcaaaaagtttctctagttgacctgaaggaaaacttatccaagtggcaaaatgatttagctggtaaagcttggaattcactttattgggataaccatgatcaaccaagagcagtaagccgctatggggatgaccgagcagcgtatcgtgtggtttcagcaaagatggttgcgaccttattacactttatgcaagggacaccatatgtctatcagggtgaagaaattggaatgaccaatgcctataatttgcaacgtgaagatttcgatgatgttgaaatcaaaaatgcttttaagtatttaattgacaaggatcatttgattgacgaagacacaatgttgaaatacgtacatgcgaaaggacgcgacaatgcacgtacgccgatgcaatgggacagtacagcgaatgcaggatttacaacaggcacaccatggctcaaattaaacgataattatgacacaataaacgttgagcaagcactagctgacaagagttctatattttactattatcaaaaactaattcaattgcgccatgatttgccaattatcactactggcaagtatcagttgttggatccaaaagacgagcaagtctatgcgtatcgacgtgtgggaaacaacgaacaactgcttgttatcaataacttcactgacaatatcgttacacgagattatagtgtaccaacaaatgcaaaaattttggttagcaattatgctgatgacaaagcggatacacttcgtccgtacgagtctaaagtttatcagtttgaaaaatagtatcttgctggatgactggcattaaatgtttattgtaaactaatctattcaaactattgtaaacgctttcattttgatatataataaaaatataaagttggattgtaaccaccgattaagttgcgatgggcaaaaccaaatgatagggaaactatacacctttcgataatcgatggtgatggggaactattatttggttttttattttcaaaatataggagtagaccatgctggtaaaaagaatttttaataataatgttctactagctgagaatagcgaacaggaattagttatcgttgggcgcggcgttggtttcaagcaaaaaataggtaatacagttgattcgagtaaaattgaaaaaacctattatccgcaagatgaaaattggacgagaatgtttaacgaaatggccgatacaatttcgtcagattatgttgaaatcgcctcacatattatttcaactgcggaaaaaagtttaggcctgtcatttgacggatacttgttaattggactagcagatcacatacagtttgcggtagaacgcttacaaaaaaacttgcccattaaaaatgaactattatgggaaacaaaacatttttatcctgatgaatatcgtattggtgcactcgctgtagcttttattaatgaacaaatgggtgtgcaattacctgaggatgaggttggttttattgctttgaagtttgttgaaaagcgtgctggcccaaacttcaatgagaaagcaaccaatatgacgcagctcattgagagtgcattaacattgattcgtcatgatttattacctgatattgattcttctaatctcaattatcagagattgattgttcatttgcgtttcttcgtagatcgactattagatgaaagccatgttcaaaaaggtgagaatagttttgacaatgtaatgtcgcagcatttatcagaaagtctgcaggagcgttacacaagctcataccaatgtgcacaacgtgtgattaactattttgaaaaacaaaccaaacaaaaaacaggagtcaacgaacaagtttacttgactatgcatctgcaaagaattgttgattcttcaatttaaattagggattgtaactatttaattaggcaaaacccaaaagatatcatttatgtgatgttttttgggtttttattttacaacataacgaggtagaaaaaatggattatggagttttggctaataatatattggctggtgtcggcggcaaagataatatcggatccgcttggcattgcgctacgcgtttgcggtttaagttaaaagatgaaagcaaggcagacactgaaaaaatagaaaatatggatggtgtgattaccgttgttaaatcagcgggtcaataccaggtagttattggaaacaacgttgcacgggtttttgaaccattggccgatgcaattggactagcaagagatgacgctcggagcgataatcaagaagaaaaaaagaaagataatattgttaatcgctttattggttttatttcaagtgttttcacacctttcttaggggcaatggccggaaccggtgttttgaaaggcttattggcactttttgtgacactcggatggttgcaagagtccagtggaacttatcaaatttggtatgctgctggtgatgcattcttctacttcttaccagtttggctggccttcacagctgcagcgcatttgaaagtgaatcaatatgttgcagcagctttggctggtgcgttactttatccaaatttgattacattattagcagggagtaagcctgtaacattcttcggtttgaccgttgtcggaacaacgtacagttcgagtgttataccaatcttgttagcagtttggatgttatcttatttacaaccaattttggataagtttttccatgattctgttcgtaatatctttacaccaatggtcagtctgattattatggtaccagttacattattggttgttggtccattaggtactagtgttggaactgtgctatcgtcgtcagtcgagagcgtttaccgcgtggcaccttatgctgctggtgctgtaatgggtgctttgtggcaagtgtttgttatcttcggcgtacattggactttcgtgccagttatgacaaataacatcagtcagttaggatatgactacttgctaccaatgttaagtgttgctgttttagcacagtcgggtgccgcactcggtgtgttcctcaaaacaaaagatgctaagatgaaatctttagcaggatcatcagtcctcacaggtgtactaggcattactgaaccggccatttatggtgttacacttaaattaaagcgaccatttatctttgcaacgattgccggtggtatcggcggtgccattgctggtgggggtggcgcacatgcgaatgcttttaccttacctagtttattagccttacctacgtatttgggtaaaggatttaccagtgtggttattggtttggttgtcgccttcattttgtcagcagttgctacttatctattcggtgtacctagccaaccaaaagacagtaaaacagacgctaaaaaccccgaagaaattcaagatgacctagtcattgcacccgtgtctggcaccattatcccactagaatcagtaaaggacgaagtttttgccagtggcgcaatgggcaaaggtattgctatcgtacctgatgatgatcaaattgtttcaccaatagtaggtacagtagctgccgtttatccaagtaaacatgcaattggtttaatctccaatggtggtgtagaagtactaattcatgtaggaattgacaccgtgcaactgaatggaaagcatttcaatcaattagttgaacaaggacaaaaggtctctgttggtacgtcattaataacctttgaccgtcaagctattcaggaagctggatatgatccaacggtgatggtgattatcacaaatacagcagattacgaaatcaccgagacacaagatacggtagctaaccaaaattggttactacaactgaaagcattataaaaaggagaataaaaatgtacagtaaagaatcaatcacaggctttccaaaggactttttatggggtggcgcaactgctgctaatcaaattgaaggggcgtggcaagtagatgggaagggcttaacaacagctgaagtcgtacgtaaagctgaagaccgacgtcacggttcaatgggagatgttaacgcagataccttacaagaagctatcgccgatcattcggatgtacattatccaaaacgtcgtggagttgatttttatcatcactacaaagaagatattgcactatttgcagaaatgggttttaaagtatttcgactttcaattgcttggtcacgtatttttccaactggtttagaagaaaatccaaatgaagctgggttagctttttatgaccgagtatttgatgaactagataaatatcatattgaaccactcgtgactctttcacattatgagatgccaattgaactaacgaagcgttacaatggttggttggaccgtgaggtcatcaaggcattcaatcactatacagaaactgtttttaaaagatacaaggatcgagttaagtactggttgacattcaatgaaattaatactagtgcttggggatttcatgaaactggcgctatggatggtgatttaagtacgcaagaacagttacaagtgcgctatcaggcagttcatcatcaatttgttgccagcgctattgcgacaaagcaactaaaggaaattgcgcccaacgccaaaattggttcaatgttagctcgcatgcaaacgtatccagcaacagcaaacccggttgatgtgcaagcagcacaagttgaagatcagaaaaatttgttttatacggatgtccaagcacgaggtgaatatccagaatacatgaatcgatatttcaatgaaaatggtatcgttattaatatgtctgctgatgatgaaaaaattttgaaacagtatccggttgattttattagtttcagttattatatgaccaacgtgacaggagtagatggtgttgaagacgggattggtaatatgagtttgggtggtcgtaatccctatttgaaggaatcagaatggggatggcaaatcgacccaatcggcttgcgagtttctctgaatgtcctgtgggatcgttaccgtaaaccattatttattgttgaaaatggcttaggagcagttgacgaattaacagcagattacaaagtacacgatgattatcgtattgactaccttcgtttgcacattgagcaaatgaaagaggctgtgattgatggcgttgacttaatgggctacacaatgtgggcaccactagatattattagttttagtacttctgagatgagtaagcgttatggcttgatttacgtagatcaagatgacgcaggaaatggcacattaaagcgttacaaaaaggattcgttcttctggtatcaaaaagttattgaaagtaatggtaaaacattagaataatagcaaaaagcgacatactgaaaaacagtgtcgctttttaattgaagtagttatttaggctggaatttaacaaatatattcagatctttgaaatcagcattataagttatttggtcttttaatattgcttctaaggtaaagttcagtctatgagctacagctatactcttaccattttcactgtcagattgaaggataattttatgaaaatttaatttttcaaaagcatagtccaacacaagatttactgagctggaaatgatgcccagaccttggtaattagtcgacaaccaataacctagctctgctcttttgtttttcctgtcaatattgtgtaagtcaatcattcccacgggagtattattaacgagtatcgtcagcataaacaatttttgtttggccattttaagccgagcataatttaaaaattgtgcctcatcttctacggttttaatattaggtgtccaaggcatccagcgtgatagagtttccctgtcttgattaataatacgaaataattcagcagcgtgactgttttcgggcatgactaactggactttataatgatctattacgaatttttgaaaagtgaacattttaaactccttaatacctttaaattatactccttcaatgaaatagtttgcgttttttgcgaaagtatcgtgatcatttaattaacaacaagtttgtacagtctagtaatttatgtcaattgcagaagtagatcagctgaataataagtgtttaataatttactcggaacttgttttatgttaatatacttataattaataagtatattactttaataaaagaggtgtgttcatgagtaaagttataagtttggttggtcaacagttagatgcgttactagaaaatgagactaatatcgtttccaacctagcaaatgctgctgccttattgtttcaaaactatgagaatctgaactgggcaggtttttatatctacaacgatgatgctaaagagttggatttaggcccatttcagggtaaagtggcatgtatgcatatcaagcctggatcaggcgtggtagggacagcttttgctaacaaagaaagtattgttgtaccgaacgtacatgattttgctggccacattgcttgtgatgctgatagtaattcggaattagtggtaccaatatttaaaaatggagaaatttatggaataattgatatcgattcgccattactgaaccgctttggtgagaacgaaaaaaatgaagtagaagagcttgctgaaatcttagcaaatcatatttaatgtccatactataaataaaaggcaactgagttgaacagttgccttttattttgataggaatccgtatcagtatctacctatttttgaggacatctagtacgtggcatttttggtaaataaccaatactagtaaacctcctagcgatccaactaatgccagaaaaagacctgagctaactctagtatccggaacaaaatgattggataatagactcaatccggtaaacagtattaataacataaatgcgctaacatagacggcatttaatacttttgtatttaaaaagtcaagaagttcaaatcgatgattaatataactgcccataataattgtgacaataaccagagaaataaacgttgataataaagcgcctagagagcttgttaaatagatcataataggctggcataggattttaacagccatgccccagccaattgccctaagtgctatgccagttttactgagtccttgtaaaatcatggctaggacagatgttaaccccatgaatagcgcaataaccgctgaaatttgtaccattggtatatataagctttccgcagcataatttccataaaataaaatgtagaccggtttactcaacgagtaaagtgctgcacaagcaggtaaggtaatggcacaaaataatacgtaagcttgactaatatattttcttagtacctcatgattgtaccggcttttcgaaattagaggcaaaatagtcgatgcaattgaaacagacaatgaaaccacaatcataattagcttattactattaaaattgaacaagccaaaaatcgtttcaattttgttacttgacagcataggattgaattttgacatcagtacgtgaaaactgaattgatctatccattgataggcaactaagaaaccaccaatgacgacgaaaggcaaagactgaacaataatatgcttaaaatcgatgatttctggttcagaattttctttaagggaatcagcatttaacagctgtttttttgaaagtgagttggtgcagaagagtaagtaaagtgttgcaacccaagcaccaattgatgctgcaaatgttgaatgtacaactacagttacccaactgccatgctgtagttgtaaaataacatatgcagatcctaacatataggccacacggacgacttgctcaatcacgtcagacttggcaatttctgccattcttagctcaccctgcagtcgacctcttaaaacagataaaaatggaaacactaatacagccaaagaaagggatcttagtacaggaatcaattttacgtcactggcagaaaggataggggctaaggaccataatgcaatgcaacaaataaatcccgcgacccaacttagtcgcgtcgcatttttcaagaattgatgcttactattaccttcaagtcgtgccgtaaatttagcaacagctgaaggtaatccagcagtcgataacattaagaaaaattgatataaattatagcctttacccatcaaagtgttagcttggagtgataatgcacctaacatcattgtccaagggatgacatacaatgcgcctaaaactcgcgaagtaatattgccaaaagcaagccatgcggtaccattggtgagttggttttgggataatttttttagtctcattttattattgtaacactgataattatttcaatatattagtgcgtctaaatttgaaaagggattgcataaatatagttacaaagtagtcattcctttgacaaaatggactggtaaggtgacgtgattgtgggacgctgtagtagtagttttttgattcatttgtgataataatttttctactgatgatttggcgatttcggcagtaggctgtttaattgaagataaaaaaatttgttgtcgtgaataaatacgagcaccatcaaatcctattatttgtacatctttgggtacattaattcccttttgagtaagcaaaaagtaaaaatcactcgcgaattcatcagaatcagaaaaaacaccgtcgtacttaaatgttgtatttacagtatttttattaatgaacgtagcaaagtcgtccacaaaattggcaatgtcacgtgttacaaatttagctacagtaatattgtgttcatgacagtagtcaaaaaatccttgttcacgaatagctgatatatttctcacaggcgcctttgaaataaataaaagtcgtttagcaccagacttaactagagtttctcccgctagctgtcctccagaatagttatctgaaacaaccaatggcacttgatcggaaacttttttttcaatggaaacgagcggtatatctgttgcaattaaattagctgcatcagcgtaggacatcgtgattaatcctgcaactttttgtgtattagccatctgtatgtattcgatttcatcttctgagcgattattcgagttgcataatatcattttatagccatttttttgcaactcttgttgcatgtagtagctcaattccgaaaaaaacggtgagttgactgtcggaatgatgaaaacaacgaaatttgattggctagtttttaaagaacgtgccgtagcatttggcacatagtttagctccgctatggcttctgctatttttttctgtgtattaggcttggtttttttcccattaatgtaattagatacagaacctctagaaacaccagctaagctagccacatcgttcatattaaccaatttcaaataccttcttcaataaattatgtaataaaaaagtgcctaattggcacttttacaattattatggtgtaaaccttcctgataacattttatcaaataattctgacatttgttgttgtttcatgttttctatttgcttcacttctaaatgattgaagtcttctatcatgaagtaggcttctaaataaagtgtcaattgatttttaataaatcgttggtttgttagcttctctggacgatttgtgttgcttattagagccatcgcaaattcgtgtggatcaatggtaaagtttttctccatggtcgttatcctttctgattactcaatgctatcttccaaattttctctagcatgtttggcatcaatataacgtgtcatttctaattctttttcgggagtcaaacgatagaagagtattagtatgaatgaaatgactaaagcgactaaaggaacccaaacataatttgcttcgatactaaatagtgctgctgcagactgggatttatttggcgcatagtgaccaagtgataaaagcatacctgtaattgcgccaccaatacccatgccaaacttggcggtaaaacttgaggcagaggttacaattccttcagcacgaacgccatttttccattccccataatcaactgaatctgctaacaaaacggcaattaatgctccaacgaaaccatttccaaagtttccaataatcgtaccaataattactagtggaacattcagtaattgtgcaccaagaccaaggattaattgacccaagatactcagtgctagtcctgatagtattgtcttcttttttcctattttcatgacaattttaggtgttaagaatacagaaactaatccaacagcattgaagaacaatgctaaggaagcgagcccaggtttatctaaattgtatttaaagaagtagatggttacttgtccttttgtctgcatacccaaccaataaataaagtttaagccaacaacaataacccatggccaattattcctaagtgcttttaaagatgttttaattggaagtgcttgttgtgattggcgggtttgtacatgctcacgtaggtttgcaaacacaaccaggtaaatgatgaagaagacggccgctgccatgacagcaacccagaagaaaccccgtcgtgggttatttgcccctccaaataaggtgacaagtggtaaagcaataactgaaataagtgttccaccaaagtttgaaaatagtgacctgattgtagagagtaaaacacgttcatttggatctgttgtcatacttggcaaaattgaggtcagtggaatattgacagctgaatataaaacgtcaataccaatataggtgacataggcccagacaattttccaattcattggtaagtctggtgttgtaaaacataaaatagtgaagatcgtaaatggggcattaaaccaaagaaagtagggtcggctgcgaccccattttgtgtgcgtatggtcgatcataataccccaaaatggtccatcaagtgcatcaattacacgtgcaactaacatcaatgtgccgacggcaccggctgtgatgccaaagacgtcagtatagaaatacattaaatatgtgccgattaagctaaatgtaaaactacaagcaaaatcactagcaccataacttaagcgttcattccaaggcaattttccattgcttttttctaccgtaactgttccattactagacatgtcatacaccttcctttttttatagatgcagtgtggttgagggagaagtatacaggtacactttgacctcatatggttttaatacttgattgtcatttgttggataattttgaataattaacttgctttcagagggtacatcatattggcgtgtgaccgaatgagaggtgaagttcgcaatgacgaacaaggtttcgtttttgttttttcgtgtataggcgaagacttccttatcttcttcgtttcctttgaataaattgaaatcaccatcggtaatcactggtaaagtatggcgtagtttgatcaacttttgataaaaataaaacagtgaattgggatttgataattcatcttctgcgttaattgattgataattggggttcacagatagccatggtttgacgtgactaaagcctgcgtaaatatcgctattccattgcatcggggtccttgaattatcacgtgaccgtgcacgaagatatgtcatcatatcttgaggtgtaattaatttttccttttcaactagctcttcatatgcattaatggattccaaatctttatattgtgacaattcctgaaaaccagcatttgtcatccctagttcctcaccttgatatatataaggtgtaccttgcatgaaatgtaaaagggcagccaacatttttccagaaatttcgcgatattcttctgagtcgttgccaaatcgtgatatagcccggggttgatcatggttattccaatacaaactattccatgccttaccatacagcgacttctgccacttggtcaaattatcacgtaattttttcaatgacacgtggttatcggaccactttccgagtgctgggttgtcgtttccatccaagctaacatgttcaaactgaaaaaccatgtttagttctgttccatctaaatttgcatatttctgcgcttcttttgtgtcgactccgatagtttcaccaactgtaatccagtcatgctttttcaagacatgtttgttcatttcagttagatagtcatggatatgtggcccattggcgacaatttcagcagcatcaccatataattctgaaccgtgtatccgaccatcaggtaatcctgttggttttgaaataagggaaatgacgtccatacgaaaaccatcaattccttttgtagcccaccaattcatcatgtcgaatattgaatgcctgagctctggattatcccaattcaaatcgggctgttctttggcaaataaatgcagatagtactgtccagaactcttgtcaagtgtccatgcagggccagaaaagaaggagccccagttgtttggttcatgatcattaactgggtcacgccaaatataataatctcgatacttattatccgtacttgtgctgctgatgctcttttggaaccactcatgttcaaaagaactatggttaactacaagatccatcattatttttaatccacgttcgtgggctttgcctagtagttctttaaaatcatgcatgtcgccgaaagtagggttgatgcttttataatccgaaatatcgtaaccaccatcaatattggaggttttatagacgggattcaaccatataacgtcaacgcctagtttttcgatatagtcaagacgatttattatgcctctcaaatcacctataccatcgccatcactatcttgaaaactttttgggtaaacttggtatacaacagcattttgccaccacattttcttattcataagatctccttcttcataaatggaacgttccatttatttaacacatagtataaaccgaatataatataaatgcaagcgcttacatttcgaaaagactttttcatattacagtgatgaaaatagcaaaatttaattgaaaaattagggataataatgtacaattcagaaagcatgcattcggttgttttcttgacagttactgtgtttagtggattaaacaagttaaggatacaaaacaattgattgatgtatatatgaactgaaataatgcataactaaatataattttttaagtctatgaaaaccaatggttataagttgaagggaggtatcgttgattgcgtttcaaaaagatactaacattgtttgttttggcagtaagtctgtttacagtcacctcattgtatccgagtccagttaaagcagacacagcgaataattacaatattacaattgatggtaactttgaggattgggcagacaaacctaagacagatatcttctttgactataacaatggcaatgttaccaaacagggttcttttttatctgacgataagtacttatatatttatattgatatggatccttataacaaaggacacaattataggtttcaaggaagtggttggaatgtccaagttggtaacaatattactagtttaaccttttcagttgatggtggaatatggtctcttcaacctggttccaaagctgctatctcttctgtttggtcttggagcaataatgatcctgataaattatttatcaaccaacaaattccaggtgtgactggttatgttaccactgaaaaatcgagtaatggatgggcatatcgcgatcgtgcagagattaagatcccattaagtggctttttaaaaaatccagatatggtgcaaagcctcataatctatgatactgataacatgggacaacaaaaagtaacggtaacgggtgctagtacgggcggaaatctgatcgttttaagcggttttattatggcgattctgttagttttatttggcaagtttttaaaaaatagaaagagaggctaattttcttgagtatctttttattaattagtggtgttatttggctatatgctttatctgtttttaaaagagccaagctcccagctttttattttattgtgggtagtgtggggctattttttattttatttttctttagtaaaccttattttatttggataatggcgcgagcggttaccattggggtttctttagtcgcgcatcccttaaatttagccactgtatattcggattacggtttaattgctattaataatgggtttaacgccattacaatgtcaattgattatgagtgctcaggagtcatagaaacagcagcattttgggctttattagcattttatcctatgtatcaagctaaagaaaaagttgtgctagccttactgggctttttgtggatgtacgttgcaaatgttattagattgattttgattgtactaattgttcatacttttggtgtggatcatttctttttagctcactcaattatcggtcgaattgtattttatatttttgccgtgttcttttactacaaagtatttacatacggttatttagcaaaaaataaaaagaaggtgtaaatgaattacctatttttttcaacgttaagtcaaatgggattctggataacttggctactgattcctattttagtagaaacagttcctgcaatttcatcttttgttaaaatatttttttatacgattggtaagccaaaatctgaaaaagatccaagtttctggccttttatttcaattattattccagtatataactctgaagatacgctgtatgaatgcattcaatcagtttaccaatcgacctatcctatagataaaattcaagtgatagtggttgataataaaagtcaagacaaaagttttaaagcttttcaatctgcacaaaacagttttccaaaattaaatatgcagtggatgaaaacagagcaaggaaaggctcgtgcgctaaactctgcaatttatagtagttctggtgcgtatattattaacattgacagcgacggaattttagagcgcaatgctttaaaaaatttaatcaaaaagtttgagagtgatacaacaatatctgctatgacaggtagtatactgacacaaaaatctttgattaaaagtactaaaaatgttggattgaagtggttgcagcgcttagagtattttgagtacgcgcaagcttttatgtcgggcaggagtattgaatcacaaaacaatcacttatatacaatgtcaggtgcattttcaggatttcgaaaagatgcattaatgaaaacctttatgtatgatgtatcaactgtcggcgaagacattgatattacctttcaggttagagacaaagcgaaaggaaaggttattctttgtgcagatgctttctttttcgttgacccaattgaaagctggaataaattatatacgcaacgacaacgttggcagcgtggccaaattgaagtatcgcaaaagtattctggaaatcgtttgggattaaaatcatttttctcaaattttttggtgagaagactaatcattgatcacacatttatgtttctaaaaacaatatggctcttcgcaagtattgcgctattgtttttaaactattcaccattattgctactactatcatatgttgccatttatcttctgtatgtttttatgagtacaatggtttttgttaatgtaaacatgatgctaaaaaaatttagtgatgagcgaacgttttatttttcgctattcgattgtgtattttggatgcccatatataattttattttgtcttgggtacgcttaattggcgtaattaatacagaatatctttctgctaagtgggctacgaaaaattatcatgaagaattcaaaacagtaggaacaattgttaagcaggactttattaaaattaaaggaggtagaaaaaaatgaatttagtaggtacctatcatctgaaatattacatccatgctagccatgcaattagatgggaaaatggcgaaggtgacgaacacgcacattcttgggaaatagcggtagagttccgttcaaccaacgaaaacatgattgtatttgataaaattgagagctctctagatgatctttttaaagcatattctggaaaatttttgaacacggttgaaccttttaccacaatagatcctactttagaaaatataacaaagttcttttttacgttagttgagaagcaaattttacctatgcacgcacaattaaacaaaattgagctcggtgaatcgccaatgagattttattatgtgacccgagatgacatgagtggtgaataggatatgaaaaagaagatattttctttgggaaatgctactattctgattttattttatttactttttggtgttacctatctttcagcgattctatcagataattttactatcggcgataacttaaaaagaggcacaacaactacgttgggattgcttgtctttattagcataatactattgttcataagcctaatttattttttacctaaaatcaaaaaggctgttgtatttgtttttaaacaacataaaaatattacatcaattgcgttatttgtattgttagttttattacaatttttgtttgtaacagtatttcatcctaaaattggctgggatccttcggcattaattaatacactagatcatgtagatgatgtaaataatcgagcatattttagtttgaattcaaataacttgcccattctgttgtttatgtcgtttctttcaaatgtttttcagttgaaaacatggttgttttttgattatctgaccatagtcatggttgatctatcgattattttttcggttgccacctcttatatgatcgacagacgttactttgcagtttctttatatattcatatattagtatttggtttctttccttggatagttataccctataccgatacatgggtcctaccatttgtatcagcatttttatttttctatttcagcgcaaagaaagtatctaaactatggcaaaaaaatatattaatgacactctttgctttacttgtgtgtggaacgtatttcattaaaccatccgcaattattcccgctatcgcaatcggtttaattgaggcacttagcttgtttaaagaaaaacgtgtgttattacccgaagtactcaaaaaaaccagtacagttttgatagttatgttttcttttatttgtttatacacgataactcaaaataaaattgagcatcaaacattaattcacgtcaatcgagagcgggctatcccagcggtgcactttatgaacatgggtatttctggtgatggtggatataatgcgcaggatactttaaaaatgggtgagttagcaactaagtccgaaaaaattgagtattcgaaacaaatgtatgttaaacgattaaaaaagttaggtgtcattggctatttttattttataattcaaaagcaaataaacaatacggccgatggctcgtttgcatggggaaaggaggggcattttattcagggagaccaaattccaaaatcccatggattaaaaggggtgctggaaaatcatctgtatatatatgggaaaaatgtggccaactttcggtttattgcccaattcatttggttgattatcttaagctgtatattttttggttggcataataaatcacagacaacacaaacaatcagattaggtatcacgggagcctttctgtttcttcttttgtttgaaggaggtagaagtaggtatattatccaatttttaccactatttttattgggcgccagtctcttggttaatgattcgaaacaaattattaaaaaaattattgatgctacgttattaaaacgaacaaactacgaatcataataattacaattttgatagtatgatgtcactggtaacagtggctttttaattatgaaagcgtgaaaattaaggttataattattttgttggaaaacacagtacgcagtaaagttaacagattaataagtttgttaattgtcaaatcatattttgaaactttacgtcaatatatgagtcatcgaacgaaaaatggagaacataaacttatgaccaaacaaaagatagtattaataactggtgctagcagcggtattgggtatcaagcagcagaaaaactaagcgcgtatggcttcaaagtttatggtgcagcacgccgaattgaaaaaatgagtccactgtcttcattaggaattattcctcttaagatggatttaactgatgaacattcaattaaatcagctgtagcacacgttatgagtcaagagggtcagattgatattttaattaataatgctggatatggttcatatggtgctattgaaaatgtccccatagaagaagctaaaaagcaatttgaaactaatttgtttggccttgcaactcttgttcaactggttttaccacatatgcgtcatcaaaaatatggccgtattgttaacatttcatctatggcaggacgtatgacaacatatatgggcgcttggtatcatgccactaagtatgctctcgaaggatttagcgatgcgctacgcatggaagtcaaaccatttggcattgatgttattcttattgaaccaggtggaattaaaactgactggggtactattgctgcagagaatcttcgaaaaacttcggttgatacaccttatgctgaacatgctttagcagcgtccaaaagaatgcatcaactttatacatctagcaggctaacagatccagatatagttgcttcaacaatagtaaggtcagtgactactaaacgaccaaagcctagatacttagtgggttatggcgcaaagatattggttagtttgcatgccattttacctacacgaatgtttgacaaattaattcaaaaggttgtttaaattttagtcaactacaaggaggtagttatggattcatttcctttggaaagaccttacatcactattactaatgtcatctggagctttgattatgacacgcaacaggtcaaagtactattaatcaagcgtgccgatgagccatttaaaaatttttgggcgttaccagaaatattgttgcgagaagacgaaagtgcacacgaagcatccttacggctaataaaagagaaaataggattatcgctttctgatgttcatgcagagcaactagcaacgtttacagcaccagatagaaatcctgattttcgggcgctgtcgctgagttacatgatatttttgccaaaatacgtgaatcttgttcctggatctggtgcaatcgaagcagaatggtttacgctagaaaagattaaaaacaattattttggcctaaaaaagggtgatttgttttttaaaacgttagctgaaaatgagtacgtaacagaactagattctcaaaagcgattggcctttgatcataattggattttaactgtggcttgccaccggatagtcaacaaactgaactaccagccgactattttattaacattgggatcttcctttacgctgaaaacagctcggcacgtctatggtatttttggacaagatgagactgataattctaatttcttacaaaacaacaaaaaaatatttgaattagttggagaagttgataaaaaagggccggggaggccagcaaaaaagtttcgcttgctaatttcattttaaagatgtagaatctctttataaataataaaagtaaaaaatacttttataaggaagaggttctttttatggataaaaagagacacttattgttcattattggcacggcatggatgattgacgcattggatgttgctttgctatcgtttatcatgccattgattaaaaatgagtgggacgtcggtagtacagaattaggattggccgccgctgtcacatcgattggcatgattgttgggtcaattgtttgcggtaaattagctgataaatatggtcgtaaaaatattatcatcggaacgctactcattttttcattgggtaatttggcgttaatatttgcgccaaacatcttgtggtttatggtgattcgttttataacaggcattggattaggtggggagttaccagtagcagcaacgattattgctgacaactacactggtacaaagcgatcacaaatgctgttattagctgatagtttttgggcctatggttggattttagcatctttgatttcttttctaattattcctcgttttggctggcgcgctgccgttgcccttgcggctttgtttgctttttatgccctagcattgcgtaagcacttaccaaatgaaccaatcaataagaaaagtcacgaaggcacttttaaagagcttctttccagcaaacatcgatcacggttaattgttttaagtataatgtggtttattgtgatgttgacctattatgggatctttttgtggcttcctactgtcctaaccatgcgtggtttttcaatcgttaattcattaggatacacgcttatcatgagtatagctcagttgcctgggtattatttagctgcctacttaatgaataagatgagtcggaaaaagattttggcaatttatctgttgggcacgttgatttcgagtttcgtttttggctttggtactaatatagctttaatactagtggccggtgcctttatgtctttctttgacttaggtgcatgggggacattaatctccttgactcccgcacaatttcctgagaaaatacggggtacagccatgggtaccgcacaagcagttgggcgtgttggtgccacggttggaccattccttgtcggttggttatttgatttcaaattaggcattagtgtcatatttagtgtctttgcagtattgctgattattgcgatagtggtgttattgataggtgtaaaagacaatctagaggacgagtattgattgttaccatagtattacttagttgtgttgtacaaattcatatgttttatacaaaaaacaatgaaatttatatacacaaattgtaagcgttgacatataatataataaagataatttatgtctttcaaaatttaaactgatagtcagaaggagaaaaaatgaaagcagctgtatggcatggcgttaaagatgttcgtgtggaggatgttgaactcaaaccaacaaaatctaatgaggtagtagtgcgtgttgcttatgctgggatttgtggcagcgacttacacgagtaccttgagggtcctgtatttattcccgttgatcaaccagatgaattgactggcggtcaagcaccattaacgatggggcatgagttttctggcgttatcgaaaaagtaggtcctgatgtggctaattttaaagttggggatcacgtttcaattaatccaactgtcacaaagggaatttcttctgatgatttggatgtttacgatggctatagctttattggtttaagcacggatggtggctttacatcatacgtgaatgtaccagaagataacttatatcatttacctgaagaattctcattgaaattagcagctactattgagccaactgcagttgcggtccaagctatcaaagaggctgatcttcgatttggcgaaaaagttgtgatttttggtgctggaccaataggtgtattagttgctgctgctgcgaaggcggcaggggctactaaaatcgtggctgtagatttgtcagaagttcgcttgagaaaagcgcttgaaatgggcgcaacagacgtgattaatccaagtcaagtgccagacactattgcagctattaagaacattattcctggtggagcggatgcatcatttgaagttgccggggtacaaccaacctttgaacaagcaatagatgcaacacgtccgcgcggaagtgtcgttattgtttcaatttttgcaaagccaatcagctttaacccaatgcaattgatgaatgcaggtgttaaactgaccacaacaattgcttattcaaaagaaactttccaacaaactgttgatcttgttagcagtgggcaaattaatgtagaaccagttattacggatacaatttcattggacagtattgtttctgatggttttgagtcattaacaagcgataaatcgcaggccaagattttaattgatttaagtaaagattaactactttaaaatatcgaagcatacaagttgctactattcttacttttgtttaggatagcggtagctttttattatgatttacacatttagctaattaatatataatgaaaagagtttaacttgttttttagaatttataacagttatggggaagagtaatggacgatgttaaaaacttatccagcgtatattgggttaatatgctgagcaacaaatttgtttttatttttaatttggttattccgactatttattttctatatataaatatcaattctttcatgcgtgacagcgtgacgtttaaccacgaaactttcaaggtcattggttatttttgggcttacatcattttagtcacaattttaaataatgtgattgttgggatgatatctcaaagggaaagcggattttacaaacaaactttcttcattgtcggatctaaatacaaaatactgggtgctaattttcttgtccagttattagtgttgaatattgaattactgatctttaattttgtggtcatgtttactgctcattattggagcataaagctattattagctggcataatggcttctatcgttgtttcattaccgattgcttttgctggtagcatattatttatgcttaaaattaaaatagagtcaataaatatcctggtgagtatgttattatttggtctatttattgggatgcatgttccaaacaatagggaaaacttaattactacctttacttcgctaattaatccgctttcatatattactgaagtgagctatcaagtgctattatttttatttaatgctaaattgtattattcggagattgtcgtttgtctattagtcacacttatttatgttttaattggttggtactctatttcaaaattatcagtaaacgcagtggccgatcgagtctaagcggggagagtaagttatgcaaataaaaaaatattcactccattttgggaaaaggattcttgcaaaaaatcttgatgttatattagccgaagataaaataaatattatctccggtggtaacggtgttggaaaaactacttttttagattttcttgctggtgtcgggcccaagacagcgactggagaaaaaattggtgttcctgcccaacgcgatattgcttaccaacttcagaacatacatttttttccaacactaaccgtcaaacaaactattgaaatgtatcgtcgattcggtaattcgttgttagaagataatgaaagctttaaagaaattaagcagacagttttagacagtatctggcatttaaaagttggccaactttctggcggagaaagaaaaattgtgttgacttatggacagtgtctactcaataaaaaattgtatatttttgatgaaccgacaagcggggtagatactacaaacgctaaaattatattaaagcttattgcagctttagttgtaaataatgaaaaaacagtggttatgacatcgcacaatttggaccaattagacggcctcccattttctaaaatagatttttaacacagttggatgctattaatatggtaatataaagttagattatgtaattcataacaaatgggagaaatacatgactatctttgaggacattaaagcagataaggataatttaacttacacagaaaaaggcttaaatcctgtattttacacacctcagagcgcgaaaattctgattattggtcaggctcctggtaaaaaagtgcaagaaacagaaatcatgtggaatgatgcttctggagatagactacgcgaatggttggatgttgatagaaaacaattttacgattctggtaattttggatttatttcgatggacttttattacccggggaaagcaaaatcaggtgataagccaccgcgtggtagtatagcaaaaaagtggcatccaaagcttattgcttcaatgcctaatttgcagttaattgttttaatcgggtcatatgctcaaaaatactatctacacttggctcgcacagagaaaataactgatgttgttaaaaattataaatcttatttgccaaaatattttcctatcattcacccatcgccaaggaataatatttggcttaatcgtaatccttggtttgaaaaagaggtagtacctcgcttgcaagccaaagttagtgacacaattaaagaaaagtgaaattgtgcgactatctgactgaagtataaaaagatatttatttaaaataaaaggaaacaaacaatatgatagaacaaaaaaatcatacaaagcagatcactattttagcaaccatcattgctttcaatattgcattatcttatattgttaagatacctgtcccagcgacaaatggatttgttaacttggttgaagctgggatatttttagctgccctgcttggtggtgcacgtagtggattgatcgtcggtggcttaagcggtctgctgttagatttgcttgctggttatccacagtggatgattttttctttaattattcatgggatagaaggattaatcgtgggctattttggctataagaaacatattaccagccaagtcattggcttaattattggatcatttattatggtggttgggtacatgttagctggtgctatgttgtataattggacagcgggattggcgtcaattatcgggaatatcgcacaagcagtgatgggattaatcgttgcattagttcttgttccagtatttaaaaagctaccacaggttgatttgaaaatttaagcttttttggttagctattgctttttccggttgattgaagaccttgtataagaagaacaacaaaagttacatttatatgatataattacaaacgaactggaaaactggagctagggttccgcaatatggtcagtgaccgagggctccatcttttgaaatattcaaaaggcacctattgatataaaaaatccgaggggaaaggtttagcgtttttactgtacgctgattctttcctcttttttgttgtttttgatttcgacagagtaatagctgaaaaataacgtaaaattcaaaactcaatatttttgttatattgaaaagtgcaataaaaaaacattaagagaatacgaagaggtaaaagatgatgagaaaaattgctttttttgatttagatgggacgctttgttcaggtggcgatttacatgtctctttggagatcaaacaagcgtttcaaagcatgcgtgagaatgaaattgaacctgttatagcaacgggcagaagtttttacgaggtacagcatttactgacgtttttagaagtagaaaattacattctgtctaatggttgctatgtcaaattcaaaggaaagctaattcaaaatgcgactatgtcgattgttgaaattcagcatatattagcaatagccaatgagtacaatattggtacaggtttttttaaccagaacggttttgctctaacaatggataatcctatcgtgcaacaacatatgagaagtatgggcagtatggatatcgagttcaatgagaagttttttgtagaacaacctgttaactttatgaatttatatttaaacgccaaaaccgagagggtcattagagagaaaattattgcagtttcagatattgaacgctatgcgccgttggccatcgatatcctacctaaaggagtttctaaggggcaagcaattaatttgttgctagaaaaggttagtgacagtagggtgacaacttatgcatttggtaatcaaaacaatgatatttccatgttcaaaacggtgaattatgggatgtctatgaaagagtctacagcggaattaaagcagttatctagctatattgcaaaaacagataatggcgttttggaaggcttaaaacattttaagttaatataaaaaaactttcgaataatcattcaaaaattttacggttaaaaaaataaatgaggccgaacagtgataaagttaaactacctaaaacactgtaggtccaactaccccaagtgcttacaaaaaagccaaaaacaaatgaacctaccggttgaatgccatcaaaaaatagaaatgttagtccaaaaattctccccaaaaatgagatgtccgtttcttcttgaataaaagtaatcatactgccaaagaaacgtgattgtatcaaaccatatactagtgcaatggtaatccaactatatatcgaaaattttaggctacctagaataagaataataccataacagatttgttcagcaaaaatacgatttgaagaaattttttgtttttgtactgttaaccacagaccgcctaccagaccaccgacagctgcacagatcaaaaacaaactataactagaagtgattttggaaaagtagtggctacttatataaggtgtggtgagtaggaagccagcgcacacaaagttaaaaatacccatagaagtcatatatagaagtaattttttgtgttcgagcacatatttgaacccgctaatggtacttattaaaaaagattcagattgatggttcttaactgatggtgttggctggtaagttattaataaattaaaaaatagtgctataaaatatgaagcagcattaattaaaataaattcactaaaatcaatgccatttattgccaataaaacgccaccaataactggggcgataatatttgcaagaccaaagaaggtatttgaaagtgcgttgaatttttgcaaataattcccgttgattacttcaggtacaattgatttagcggctggatagttcagggccagcattacatttagtataaaagtaatcaaaattaaaagccatatttggggagtgttattattaattagaaaactactgacgacacaaaccaaagtagcaataatatcagtccatattaaaacatattttcgattgtgttgatctactagtaaaccgactaataaatcgccgatcaagaacgcaaagccaccaattccctcgatgatacccagtagttgcgtagtgccagtagattttactattagccagtttagccctaaaacatatatagctgagccgatttgtgaaaaaaatgggcttaacattaatgaaacgtgggttcttttcaaatgatttgtcataataaaatccattttaaacaaatactttcagtaaaacaatataaattagatatgttctctttatgcaaataaaaaagaccatctttcctcaggaattaatgatcaatggtaagataatttttattgtgtttctaatttaaagcatcaactatagcttcattaaatgatggaatgtcttttggttctcggctagtgatgagattaccatcaataaccactggcttattctctatacgggcaccggcgtaataaagatctggttgtactgttcgatatgctgtcatggttcgacccaatactaagccagtaggaatcatcaattgtggaccgtggcaaatactaaataatgacttattggttgccaagaaatgttttgtaaaattaacaaagcgttcatcggctcgcaactgatctggagaaaagcccccgggaataaacaatgcgtcaaaatcagatggcgctacatcgccgattgatttatcaatgtcaattttggtgccatgttttcctgtaacagcttcagcactaaaactgattgttgtaactgaggcaccactttcttttagtgctttgacggggtcagtgaattcaatatcttcgactaagtcggttacgagaacagcaacttttttactcatgactaattcctccttctataattaattcaattgtaacgataattgatatagaatgaaaacgatatgtcttgtaaataatgaataagtcattatctttgtaaacgttttctgttggtggtatattaacatcaacaaattgaatgtgtcactttgttgagaaaaatttcttttttttatatagaatattcaaatcgactgctagcacaacaattgcgtgttgtgctttttaatttaaaaaatttaaattttaaagatatagtagtgagcattcggcacgcactcaaaaggagatggaacaatggcattattatctgaagaaatgaaaaaaatgattgaccaacagctaccatttttagcgactaccggaggagatggatcgccacaagtcggtcctaaaggatcaactcgtgtgtatgatgatgaacatctgatttactatgaacatacattcaaacaagcttatgcaaatttacaacaaaatggttatgcggcagttgcagttgtggattctaatgtagagaaagggttccgctttgaaggaacggccgttattcatgaagatgatgactttgctaatgacattttagccaaaacaagcatattcgatcgttttccaagagcggccgtcgtcttgataagtattgatcgcatctataaattggataatactctggaagctggagatcgcattgcctaatagtcaagagaatatggaaaaggaaaatgtcatgacaaagcctattaaccatcaagtgatcaaaacagaagcctcaggaattcgtcttgtcttggacttagtaaagaaacctgctgaccaaatgattgaattaacggtcggcgaaatcgatttacctacgcccgcagcaactaaagaagcaggtaagcaagcaattagtaataacgtgacaaagtataccgagaatatgggattcctgtcgcttagaagagtgatatctgattacattaaaaagttttatgaagtaagttattccccagaaagcgagatacttgtgactgttggtgccagtcaaggtattgacctcacggttcgtgcgctcattaacgccggtgacgaagtccttctaattgggcctgcctatccagcttatatacaagcagtagttctagctggggcaattcctgtcgtggttgatactcgttctactcattttagattatctccagagcaacttgagtcagcaatttcaagcaaaacaaaattagttattttgaactacccaaacaatccaacaggtattgtgttgtcgaaagaagaattgagttcactagcgtcagttattcaacaaaacgatttatatgtgctgacagatgatgtttatcaaagactaacatatgatcaagattgtgcgccatcaattgccagcgcatcattaatgaaagagagaacaataatagtcaacggtttgtcgaaatcgcacagcatgacaggctggcgtatcggctatttagctggtcctaaagtactaattcaagaaatctataaaatacagcaagctaatgttggttgtgcatcaagcatctcacaaatggctgccctaacagctttaaccaccgatattgaagcaccaaaaacatatattagggtgtttagaaagcgtagagactatgttttgcagcgcttagatgaaatgtccttaaactatactaaacctgatggtgctttttatgtgtttatcgatgtaaaagcatttggcatgtcgtcttgggattttgttgcattcactatcaacgaatctgatcttgttttagtacacggttctgcttttacggaggccggtgaaggatacgtgcggctatcttttgcaaatgaaatgcaagtactcgttgaagcgatgaatcgtttagagaaaactgtagatgttttaacgacaaaaaaatccgctcatttaagttgacaaaataaatacaaaagactatcattgtaagcggttacacgtagtggtttatcggtacactaagaaaggaagaaaatgatggatagtctatctaatttatttgatcttacaggtcgagttgcgatagttacgggtggtgcttcaggattgggaaaatattattctcaagctctattagatgcaggagctgatgtttttatagttagcagaagtgaaagaggctggccagagttaacgcagtttgctgaaaatcgtaatcgaaaagtgcgatttatgagcatcgacataactgaaagtggcgcggcagaaaaaattgtcaaaaattgtgttacaacttttggtcaattagatattttagttaacaacgctggtatccagattagaaataacgtgctggattataaggatgaggattggcgtaaagttattgatatcaacctaaacgcattatactttttgtcacatgaagccgcaaaattcatgacaaaacaaaaatctgggaaaataattaatattggatcaatgcaatcgtttcgagctggaaagtttatttttccttacgctgcaagtaaacatgcagtagtcggactaacaaaagcttatgcagatgctttagcgccctatggggttcaagtcaatgcgctggctcccggatatattgatactgaaatgacaaaggctctccaaaatgatccagaaagaaataccgaaattctaaaccacattccggcaggacattgggcaaagccatcggaattaatgggtacggttatttatttagctagtgatgcttcaaattatgtgaatggcgcaacaatccctgttgatggcggctatttactaaggtaaggttcgtatttaaaaggagaattaattatgccattgttaacagttttgattggtgtcattttactcgtattcttgattactaaatttaagttgaacacttttttatcgttagtcattacagcgtttgttgtcggcttaattttaggtattccagtttctgatatttcaacaagtattgagacaggaataggtggtcagttaggccacttagcgattatatttggatttggatcgatgcttggaaagttaatttccgacgcgggtggtggctttcgaattgcgcaccagctcattgcgacttttggaaaaaaacgcattcaaattgctgttattattacgtcgtttattattggtttggctttgttttttgaagttggattagtcgtgttattgccaattatcttcgtcattgcgcgtgaagtaaatatgcctcttttgtaccttggtattccaatggctgcgacattaaatgttgcacacggtttcttaccaccgcatcctgcaccgactgctgtatcacaggtgttgaatgcgcctttggggcacgttttactaattggtattttagtgtcaattcccacgatcattatttctggtccggtgttcaactattttttgcatcgagtatatccgcaagtttataaaaaagatattaatatttctgttttaggtgagtacaaagaattcgagttgaaagatacaccaaagtttggtattagtgttttgacagcattattaccagtaatattgattagtattgcaaccatcttatcatttgttttgccagctaagtcagttatttatcaaatcgtcacatttatcggtgcacctgatgtagctatgctcatatcattaattgttgcgattttcaccatgggtattttccgtggattgaatatcaaagaaattggtgacgcaatgtctgaatcggttaaacaaattgctatgatgttgttaatcattggtggtggtggtgccttcaaacaagtattagttgatggtggtgtttctaagtatattggcgatttattcggacaaactaatttgtccccaattcttgttgcttggttaatcgctgccttacttcgcgtcagcctaggatcatctactgttgcttcgataacagcagccagtttagttacttcagttgtgtccaactcaagtgtgagttctgtattagtagttttggcaattggtgctggaagtatatttgctgatcatgttaatgatgctggattctggatgataaaagaatattttggtttaacattgaaagaaacgttcttatcttggacgacattaaccagtgtcatctccgtttcgggtctgttatcgattctactcgtgtcatgttttatgtagtgcagtaaattaattatgtatgaaataagtttaaattaaggaaagtgggtaataaaatggaacaagcagattttggtgttgttggattagctgtaatgggacgtaatttagcgctcaatattgaatcccggggttatcgagttgctgtttataatcgttctcgcgaacgaactgatgatttagtccaaaagcatgaagataaggcatttatcccaagctatactacagaggaatttgtggaggctatcaaaaaacctcgccgaattttgctgatggtaaaagctggaaagggtacggatgctgttattgatgaattattaccacatctagaaaagggcgatatgctgattgatggcggtaatacttacttcgaagatacgatacgccgctcagataaattagctcaagaaggcattaactttattggtatgggtgtatcaggtggtgaattgggtgcactgcaaggaccgtcattaatgccaggtggtcaacgcgaagcatatgatttggtagctcctattttgacgcaaattgcagcaaaagccccagaagatggtaaaccaaccgttacgtatattggccctaatggcgcaggacattatgtgaaaatggtgcataatggcatcgaatatggtgatatgcaattaattgcagagtcctatgatattttgaagcgtgtcttacatctcaatcaagagcagttatctcaaactttttctggttggaatgaaggagaactgaactcttatttggttgaaataactgctgatattttaactcgaaaggatgatttaggtactgacaagccaattgttgatgttatcttagaccgggccggaaacaagggcacaggcaagtggtcttctcaatcagcgcttgaagttggagcgccacagtcattaataactgaatcagtttatgcacgttatatatcagcaatgaaagatgatcgtgttgcggctgcaaaaacattgcaaggaccagactattcgttttctggtgatgagcaaagtagcgtagaggatattcgaaaagctttgtattttggaaagatcatgtcatatgcacaaggatttgatcaacttcgtatggcatcagagcactatgattggcatttaccatttggagaattagcacaattatggcgtgcaggggcgattatccgtgcccaattcttacaacgcattacggacgcttttacaacgcaagcggatctgcataatttgctcttagatccttacttccaacatattgctgaagaataccaaaatgctgctcgtcgtgtagtagcactagctgttaccgctggtgtgccaacgccttcattgtctgctgctgtagcttactacgattcatatcgttcagctgttctacctgctaatctcacacaagcacaacgtgactattttggtgcgcatacctatgagagaacggataagcctgctggagaaatgtaccattatccttggtatgatgaagcatgaaaaaaaccgtccaagacggttttttatttgaatgtactttcttattgaaaatgtgctacaattctctacaaatatgatttgtggggtgaaataatggaaacaatttttcctaaaaaaatacaaaaagacgatgaaataaggataatatcaccaagttcttcaatcaagcgagttggtgggtttgaccaaaatttagtggccaaggaaagattggaaaaattaggctataaagtaacatttggggatcatatacttgagaatgatctgttttattctagctcaattactgcgcgtattcaggatttacaccaggcctttattgatgataacgtgtcagtagtgatgacgaccattggtggcttgaattcaaatgaattgctgccttatattgattgggagataattagaagccatccaaaagtgtttattggctattcggatataacaagcttacacaatgctattcgtgcccagacaggattagtaacatattatgggccatgttactcatctttcaaaatgaatgaattacagaagtatcaaacaaacgaatggataaaagcattaggtcagtcagagtatgatttacaaccaagtaggctttggacaagcgatatgtggtttgatcctaatataccaagaaagccaatgcctaattcgtggcaagtatataactcgggccaagcaacggggataagcactggtggtaatatacaaacgtatgggctccaagctgggacaaagtttttgcccgccgtcacaaaacctattatatttattgaacaagctgagggcggagaaccacttgaattttctagagaattatctcaaatgctacaaattcatccagatattgccgcattaattattggaaggttcccagttgaaaataaaatgtcagaacccaatcttcacagcatattagctaaatttcctgttctcaatactattccggtggtttatcatgttgattttggtcacactcagcctatattcactttccctcttggtggcatgattactgttcgtgctaagaataatgccgatgttacgatagaagtgttaaaaggatagcatttatgccagaaacaaaaatgatgacgatgtaaacatggtataattatagaaataatatattttgtggggaactcgactacattgattaatgacagttaagttgaaaaaatatattattttattcttaattcagggggtattgattattgagcgggaataatcaaaaagtctctaacacatttatttatttaactttcattatttgtgtttggcttatttattttatatttacggttgctatattagttttattctgcaattttagtcgagcaatctttcttgctatgataatatctagcatcctaacattattgtttgtcataatacagacttcatttaaacatttgaattcaatcaataacgaagatgattaaatttaaaaagctgccttaacagggcagctttttttgtcgtatttttcaagaaataaaaacaactttctggatgataatatttattactaactattcaaatcaatccagtatcgacaaaataattttcctgtgctgggttctttgatgatattttcaaggacgccaccattggattcaattgttttgcggctagcgatattccatttttcagcggcaatcaagacaggtgaaattttacgttgctgataaatgtttagtgttaattctaacattttcttagctattccctgttgacgccaggcaggggcaacgccgtatcctatatggcctccaaaattaagcaagtggtcatttaactgccagcgagctgatacgccgccttttatcaaaccatcctcaataaaaaaataattgctggcgggaacaaaattattaatactattatttttcatttgctctagattagctaaatgttcagcgaaactgccggtaatgggtttggctacagaaacaattactgattcagtggtccaactttttatccagtcgttaaaaattttttcatctgattgttttaattctctaaaagtcatttgtttcccctgatgtgaccataatcattgaatgtatttaccaataattttatcatagtaatttatgtggttttatatatttttaataatcaccataaaaattactcttgtaaggtaatttccgcaagtatgaggaaaacaattcaatggcaatgtaagcgcttacttgataaaatgtgagtagttaaaggaggactaaatatgtctaaacgtttatctgaagattttctttggggtggtgctgttgcagctcaccaattagaaggtgcgtggcaagaaggaggtaaaggagttagtgtcgctgacgtcatgacggttggtggaccagacaaagagcgaaacattacgaaaggagttgtttcaggagaatattatcctaatcatgaagcgattgatttttatcaccgttacaaagcagacattgccttatttaaagaaatgggatttaaatgttttcgaacttcaattgcatggacaagaatttatcctactggtgaggaaagcgagccaaatgaggcaggtttaaaattttatgatgacttatttgatgaacttatcaaaaataatattgaaccagtcatcacgttatctcatttcgaattaccgtaccacttggttacaaaatatggtggtttccgtaatcgaaaagtaatcgatttattcgttaagtttgcaacgacttgtttaaagcgatacaaagacaaggtcaaatattggatgacgtttaacgagattaacaatcaggctaactatgataatgattttctggttttcacaaattctgggctgcattttaaccctggtgaaaatcgtgaggagggtatgtatcaagctgctcataatgaattagtagctagcgcacgtgttgttaaaatgggtcatgacatcaatcccaattttcaaattggctgtatgattgctatgggaccaatttatccagcatctatgaatccagatgatgttctggcagctcaaaagagcatggaaaaaaattatttctttgcagacgtgcatgtcaatggtcaatatccagcatttttaacaaaatattggactcggaagggatttaacattgatgttacccaagaagacctggcagacttacaagctggtaccgttgattatattggttttagttactacatgtcacatgcagttaaaaagccagaaggtttaaactttgatgacatgacaccagaaaatagccaagtacgtaatacctatttagcagcaagtgattggggatggcaaattgatcctaaggggctgcgttacgccctgaactggtttacagataaatatcatttaccattatttattgttgagaatggatttggcgcatacgataaagttgaagaagatggtacaatacatgattcttatcgcattgcatatttacaagaacacattcgggaaatgaagttggcggtagttgaagacggcgttgatttgattggatatacaccttggggatgtattgacttggtttcagccgggactggagaaatggacaaacgatacggatttatccatgtagacaaaaataaccaaaatgagggttcattgaaacgtagcaaaaaggattccttttattggtttaaagacgttatcgcaacgaacgctgaaaatattaattaaaaaggagaaacacgatgaaaaaagctttaattatttgtgcagctggtatgtcatcctccatgatggcaaaaaaaacaactgactatttcaaaaataaaaatatagatattgaagtggatgcgattactgctacagaaggagaagatgctattcgtaatagtgatttcgatctatttctggtcagcccacagacaacaatgtatcttgaaggttttgaaaagattggagatgaggttggtaaacctgttgtttctattccctttaaagcctatatacccataccaacaggtattgagggcatggcgaacttagtacaggaacatattagttagcaatttgcatggtaaaggttgtgtgaggtgtgatgatgaggaaaaaagagcgtgatttactaatctatttagtagataattcagatcgtttcgtaaccagtgaagaattatctactcttttgtcactgacgcctagaacaattcgtaattatatcaaaattttaaaagaaaccttagtttcacaaggtgccctacttgatgcaaaacccagtttaggttatcggttgcacatatctcatcccgttacatttgacttatttttaaataaaaattatgaattatcccagtggttaattaatgaggacagcaataatatttcggaccgtcaaaagtatattttgaacaaacttattattgaaaatcaaaaatttttaattgatgacttggctgaaaaattatttgttacaaggaccacactttcaaaagatttatcgatcattcgcaaagtgttaatgccatatcgaattagtgtcgaaagcaaagccaatattggtgtcttcattacgggtttagagcgcgataaacgtcactttattctagattactttttcagtcatagtgaaaattctattcaacattatatgaaaaataaatctttctttaaggcaattagttttgatcaaattacgattattgttcttgatgaatgtcgagaagctggcattcatttaacggactttactatacaaaatattgttttatacattgcactaagcgttcaacgattgaaatgcggctttgaattacaggctgctccagttgacattaatcctgaaatcagaaatgtttgtgatgttgctagaaaaattttttctcgtattgaaagtggcttagcattaaaatttccggaaagtgaagtagattatttaaccattcaattaatggcacaagggaaaaatattaatatacaaaatgatggtcccttgcaacgggatttagatatgatcttgcaacgaattgaattagaaaccgattatccagttactaaggattatgctctcaagaaaaatatcattgaacatctaaaacccatgatagttcggcttgagcaaggtattcaattgaaaaatcctttgttacaggaaataaaaacgaattatttaagtgagttcatggataccaagcgctatataaaatggtcgccttatttatctcagtttgacattaatgacgatgaagtcgcttatctagcacttcatttgatggcagcagcagaaaaatacaaaaatttaaataaaccaagagccttaattatctgcgcaacagggtatggatcggcacagttactcaacaatcgtgtcgaaaaagaatttggcatgtatttaaacattgttgatattaaaggatattatgaagttgatgacactactttaagtaatgttaatctcattatcagtgctattgatctgtcaacacgtgttttcaaggttccagtcatacaggtaagtatttttttaaccgaagcagatgttcaaaaaataaatgaatttttagataatgagcaagtccgaaataaatatattgctgtagagaaaaagcaaccaattaatagtgttttaaatcattttgatcaatttattgatcagtcaagttttaaaatatggcaggtatcgcctcatcgaaaggaattactacaagagttaactaatatgctgatgtccaatgaacctaccgaattaaaacatgaatttttggaacaaatcgatcaacgtgaacaactgagctcaatcgtttttagtgatactatcgccgttccacatcctgctatgccgatgagtcgagtacccaaaattgctattggaattataccaaatggtgtcagatggtctgacgagcatccaaacattcagctagttttcctgctatcaccatcctatcggagcaataagggtttgacagaaacgacgcaggcaattgtaaaatttacagaaaatactgaagaacagggtcggttggttgcctcaagaaatttttcagaatttcggcataattttctgttaatgatgaaaggaggtaagtatatatgaaatcagaagacattcaagttgtcgcttttgaaattattttacacagtggaaatgcgcgcacaatggttcataaggcttttgaagccatgagagaaaaaaactttaagttatctaacgaaaatctaaaattatcaaatgacgagttactattagctcataaatcgcaaacaaacttgttacaagaatacgctgagggtagtcatattgatatggaaattatattagtccatgcacaagaccacttaatgacaacgatgactttacgtgagatggctattgaaatgcagactctttatgaggaggtacaagacattgaaaaaaggaatcaaacgagggccaaaaaagccacaggataaacagcacggtttagaggtcgcaatcgaaaaaaatcgtacggaaatgagccttaaaagcatgcagtttaatcgattcatgttaatccgttatgccacggcattctttctgttcgtaaacttgtattgggccataattatgtggcagaccctagtggcactaatacctgttgctttaatgtttatcgcttcgctagcaattattgaacaaattaagttatttggacatcatacgaaccaactgatttattcaaaagtgttcttcagatcacagcttatcgtgaatatcattttaatggtgagcatcccaacatcgttatttacatttttttaccaatttatacaaaatactggtagtaaccgcttagtggtactaatcctgttattactcagtagtagcatacttctcatagttaacaaaaggttaggcttgattgcaacaaatcacgataaatattacgcacgtttgacagcctatcagtccgttcttaaaaataataaggagatgaaatagttatggaaaatggacctatgtttaacttcctacaaaaagtgcttttgaaaccaatgaccaaagtttcccaatatagaattgtgagagctatcatggctgctggtatggcttcaattccttttacaattgtgggatctatgatattagttttgaatatattaccgacagtatttccgttcttaaatgattttttcgacgcaacattctttaagtttagcgatttgtacatgattgccaacacagcaaccatgggtatcttagccatgtattttagtttagcaattggttttgaattaactcgtattattcaaacagaagataaactaaaagtagcgccattaaatggtgccttcttatcactatttgcattctttatgtgcttgccagaattggttttaaaaggcggaaaaattgttctgctaaatactatatccaaggacgagacagttatcaacggatttagaatgactagcacaatcgaccgtgttggaacaagtggtattttcacagcgattattatggctattttagcagtttggttgtattcattctgtgtgaaacataactggacgattaaaatgccggatgctgtaccggaaggtgtatcaagatcatttacggcattgattccaactttcgttattgcttttgttgtactgggtattaatggttccttagtgttactcggtactgacattttcaaaatgattgcaataccatttagcttcgttacaagcatgactagcacctggctaggaattatggtgattgagttcttgattcatgccttgtggattgttggtattcatggcgctaacattatttccgcatttattacgcctatcttcttagcaaatatggtagcaaattcaaatggggctaacataccgtttgctggagaatttaataatgcctttgctatcttaggtggctctggtgcgacacttggattatgcatatttattactttactagcacgttccgaacaactaaaagttttaggccgagcttcaatcgtaccatcactttttaatattaacgagccgttaatatttggattaccaattgtttataatccttatctagctattccatttttcttggcaccaatggcaacagcttccgttgcttatgcagccattaacttccatatcattcggccaattgttattcaagcaccatggccatccccagccggaatcggtgcatttattagtaccgttgattggaaagcagcagtcttagcaataatctgtgttgtaatagctttcattatttacttaccatttatcaaaatatatgatactaagttgtacaatgatgagcaggggaaaacacaagtacagccttaatgacgaggcatcaaaatactggtctgtgtttagtaacagactggtattttttatatactcgactggctgatttgtgaaaggtaaatttcatcagtaaggatatcacttaatgacaaacttatgtgaaaaatagaatgaattacttacatttaatagaaaatttatgatacaataatgcttgtgctaggggcgccaaaatggctgagaagaacccttcgaacctgaactgattaacatcagcgtaggaaagtgctacattttttaacgtagcatttttctctaggtgagaaaaatgtttttttattgcataaaatgacttgttgagaggatttttttgaaaaatgaataataatcactaggggcgtcgcaaagactgagatgatgtatatcggtccctttgaacctgatctagttaatactagcgtaggaaagtgaccaatatttgataacgacatgtactgttgtcaaaagtgtccttttttatgtatttaagggcactttttttattggaaaaggaatttaattatgatgacaccaaaacataatcgaatcatggatcatggcctagctggaatacagcacgtgtttgtttctaacgtatggttagatccaatttatgttgccgctgccgcagggctctcactgaacttatcaactaatcttgtgaacacgatttttattgtttcaggattagtcacgcttacacaggcaacaaaattagcgaagctgcctattgttcaagggccgtcagctgcttttgacgcgttaatgattaatgctggtaaagctggtcagttagcaacggcgagtggttcaattttactgagtgcactcattgtatttttattgtccgttacaggacttatcaataaactaatcaaattattgacaccagcaattaccggaacactaatatttttggttggtatttctttatctggattcacactatctgaattcttaggtggttatccaggtgataaaggtttctcttcaccaacaacacttattttgtctgttactacagcaactattgtcattctattgtcgatatttggtaagggattttggaagcgtttttcctttttaatcgcgctaattgttggtgatattctagcagtttcgttaggtgtcgtagattacagcgtattatcaacaaaatcatggtttggcatgcctcatttattgccttatggatcgctaaagtttaattgggtcatgtttttgacattctttgttgcctatgtggttgcagtggtagaggctttaggtgtctatcaggcagctggcgatactttaaaagaaaatatttcaccaaggcgcattcaaaatggtctaattggcgaatctgcgggatcaatgttttcatccttgttcggagcctttccaacaactgcttttgcgcagaatgtagggattttaaacttaactggtaatgtttcgagaataccagtaattattgcaggaattttgtttgtcgtactaggttttgttcctaaaattggtgcgtttttggcaataacgcctagtccagtgattgggggcatatttttgcccgcagcaacaactttaattctgactggattcaacattttgaaaagagcgcctgacaacaatgaaaataacatgattattggattgtctatcatactagcgattgctctgcccaactatgcaaccggctggtcaggtgttacaggtgaattattatctaatagcatattagtcggtgcgttgtctgccatcatcttacagtttgccttggttaacttaccacgaatgataaaaaatataagaggatctcatgattgaaaaatctaaaaaaattcaaagcgacattttaactttcattaataaatacaaggatcatcaaacagagcgatatgaatcggacttcaatcagctagctatgcgcatttttgcttatcaatttcaaaacaatttaccatataaaaaatttgcccaattacgacataaaaacctcttgaccgtaaaaaactggcgcgaggttccgctaattccgattcaagcgtacaaagaattaattctgtcaaccgaagatattaatcaagctgcggatgttttttattcgagtggcacaacaaatattaatcatagaagcaaacattatatctcgaatttaaatatttgggaagaatctatgcgggcaggattcaagaaaaacgttttgcctaatacggataaaattagaatactttctttgtttccgggtatggcagataaccctaactcttctttatctcgctatatatcaaccgctatacgagaatttggtactgaaaatagccatatcttttttgaaaataaccaactaaactattcggaactaatcgttgctcttcaagaagcagaaaaaaatcatgagtccatattacttttgggtgcttcgttttcttatgttcatctattggcatacttacagcaacatcatcaatcctttaatctggcaaaagaaagcattatttttgatactggtggatttaagggcaagtcaaaagaagtgagtatgactgacttatatgctgatttggagagcacatttaaggtgacacgcgaacaaattataaatatgtacggcatgacagagattagttctcaatgttacgatcgaaatttaatggatcattcagaaaataaaacagtttattttgataaaatagcacctgcttgggtaaaaactcaggtcttggatactgaaacgttacagcctgttgcacagggtcaacgtggcctattggcatactatgacttagctaattgggattcctgcgtatcaattctaactgaagacattgttatcaaaaacaatcatggattcacaatcattggtagagcaaaaggatcggtggctaagggttgttccatcaccgctgatgagcttttacaactgcaataaaggtgtcaataatgtctaataaagaaatgacaaaaattaatattttttacacgccagacagcattatccttggtgatttaaccgaaaaggtagttgaaaatgaaacacatcatcttgtattgtgttatcccaaaataaccgaacaagaaataaaagagattacaaaaataataacgcataaccgtaatcattatttaaagcatcttacagtgaatgaaattattgatattattgctcgggcagcagaaaaatggactaacccatcgtatcatcttcggaaaatagcagaaaaagcagtccccgcggtaactggttatgacgctgatcaatttagtttagagctcaaaaactttattcgcttatttcgaaagaaagaattaaaacgatttgtgaataccgaacttggacaatcaggtgcaatgttggatgattttcaaccaaacctttccggtggattttcaaaattttacgggccagatttaatattccaaatattttccggcaacgtgccaggcatacaactgtggacactcatcatgggactacttgtaaaatcgccaacactggggaaaacatcttttgcagagcctattatgccagctttgtttgttcagacgttagctgaaattgatccaaaattggcaaatacgattaccattctaccatggcatagtggtgaaaaattcgaggcgcactgtcttaatttggccgatactattgttgtgtgtggtggtaaagaagcggttgcatctgtaaaaagcaaaacaccattaaataagaagattttaagttatggatacaaaatcggtttggcaatagttggtagggagacgttgacaccagagtattatgctcaagtcattaaagacttagctgaggacattgccacctatgatcagcaaagctgtctagctccgcagtcaattttcattgaaagaggcggggcaataacgcctcaagagtttgcgagtatcctgtccaatgagttaaataactatcaaatcaaatatcctcgtgcaccgatacacgaatcagataaaatcgctattgaaaaaatgcggcaagaagctgagataacgtctataaaaaacggagcaacctcagtatttcgaagtgacaatagtaccgcatggactattattttacataataatatcggatttagcgcctcgcctttgaatcgttcaattcatatttttgttgttaatgatttgactgatttaccacctgtactcataccgcatcagcaatatttacagtcagcaggaattgcgatttctccgaatcgtttgttctcgttggcagatatgttagggaaagtgggtgttaatcgaatgagtgcgctgggaaagatgaatcacgtttccagtggctggcaccatgatggacgctttaacttattggatttagttcgtgttacagacattgagcagagcttagaattctctagtgagaagtttgatccggatgtggagtgaggagaataaaaaatgctattaaaaaataaagttgcactggtgacgggagccagtcgaggaattggggcagccattgccaaagagtatgccaaacaaggtgcctttgtcattatcaattacctggaaaatactaaaaaggccgatgaagttgttgcagaaattatttcagatggtggtcaagcaattgccatagcatgtgacgtacgtgatgaaaaacaagtgaaaaacatgctatacgatatttttgaaaattttggtacgatcgatatcattgtaaacaatgcattaagtcaatatcaatttgatcctaagcatcgaaaaatgttagaccaactgaaatggagtgactaccaaaatcaaatcgacggtagtttgaaagcagttttaaatgttactcaaggtgctttatcaagattaaaaacaaataacagcagtcgcatcattaatataaccagtaatttgataaggtctccagcaatcccttatcatgattacattgtcggaaaatctgctgttcttgggttgacacgtacaatggctagtgagttaggtgcttttggtatccgagtaaatgctatcgcaccaggattgacgtacccaacagcttctagtaagtacacgcatcgtgatattcgggaagcacttattgcgcaaacaccgactaaacgtttaactactcctgaggatgtggcaggttcagccgtatttctggcctcagagctttcgaataatatgaccggccaatgtctgttcatagatggtggtttaactatgctctaatcgaaatcaacacaataattaaaatataaaacacaatggaatattaaaaaggaaatcataatgaataaaaatgttaagttgacaaaaataatggtcgttacaattatgatagcgctagatatcgtgttatctccaatttttagaattgaaggtatggcgccaatgtccagtgtcatgaatattattgctggtgtaattctaggaccagtatatgcagttgttatggcagtagtcactggaataataagaatgctaatgttaggtatacccccattggctttgactggttcaatttttggtgctttcggtgcaggtatcttgtataagtatggccgcaatatgtattggtcaatgtttggtgaatttcttgggaccggaattgtaggatcgttaatttcagttccggtgatggtctggtttactggacaacaacaaaacttgtactggtttgtgtatacacctcgttttgtgggtgcaaccataattggatcagtaatcgcttattttgttttagtaaatttgctaaaaataaattcttttaaagaaattcagagaatgtttgttgggtagcatagctatgaaaaatgaattaataaaaattaaatcaattttacctttgcaaaaggcaccgttagtacattgcataaccaatgatattacgttagaaacggtggctaatactatattgtatcttggtggtaaacctatcatgagtagtgatacccgtgaattttcgtcattatttcagtcaacagacgcactactactaaacatgggccgacttaatgagtcacacgaacaaagtctcagtcaagctagctctttagcagatatgactaaaaaaccgactgttgtggatctggtaggctatggtattactaatgaacgaacaaagttaggaatggctatggcgcgtaatcatccaacagttatcaaaggaaatacttcagaaatcagaagatttgtcggcttaccatcattagcaaaaggtattgatggtgctagctctgatcagcatgatcaggcgttaaaagatctcattttgtctttgaaacaaataacaactgagtatgccgatactgtgtttgtggcaacagggaaaaaggatgtcattgttcaaaatgataaacaccttattttgagcaatggcgtcgatgaattggataagtttgttgggacaggagacatggttggcgcaattataactacacttctcgcggtcggtgaagatccgtgggttgctagtcaatttgcaattagctacctcaatgtagctgctgaaaaagcattgtcattaacaaacggcatggaaaactttagacgagaagttcttaaccaaattgatttgctagggagaaatcaacagtgggcaacgaaaattaagtattcgaatttttgaatctaggaagaaaaaaataatggcaaccaaaaatattctgttgatatgtaatacaggtgcttcaagcagctttatggctcaaaaaattcgtcaagcatcaaatgaaaatcagcaagcttgtcaagttcatgcggcaagtatgactcaaattgatgaatacattgatcgtatcgattatttattaatttcaccacaattaaagtatgcagaaagtgaaatacgattttcagtagcgaacagtaatataaaaattgctgtgattccctcaaaagtttatggactcttagacggcaacgcagtcctaaaccaaatacaaaaaatgtaaaatttgaaagaataatgatgaataatattttaaatagtcagtttattaaaaaggtaaacgaagttacctcaaattcatggatacaaggtattcagaaatccattacgttgattttatcctttataatcattgggtcgttaattactgtaattagtttaataaataatattaaagctaatctaatccctgatttaggctacatgtcaacctttacatttggaatggtgggactttttgtcgccttccttattccctataatattcttcaacaaaaaaagaacgataaaaagatgttagcgagttttacatcattggcattatacttaatgctcatcaaaccaaaatttgatggttcaggcaatcatgtaacgtttgaactcagccgctttggttctgcaggactatttttgtccattatcgcaggaatagtagtaactgcaataatactattcactagcagatattctttttttaaaaaagatacattaatgccagagtttatcgtcaatctatttgactctttgataccaataacatttatcatattcatagggtggttaggcttaaccgctaaaaatattgacccatttaaaattgttacttcacttttttcaccattatcaatcattggtcaaagctacataggctttattgtgattggatttgtatatagtttattttattcgtttggtattagtacgtggacattatcaccaattattttacctattatgcttagcggtatcgcagagaatgagcgactagctgcccatggcttaaaagcagtgaatatcacaacccaagaagttttttatacgggatttattgcagcaggaggaattggatttacgattactttagcaattatgatgctatttctctcaaaatcacaacaactaaaagcagttggtcgagcaacttttcctgcttctattctcaatattaatgagcccttagtttatggagcccctattgcatttaatcctttgttaatgataccgatgtggttgaatggtattctaattccagcagttgctggtgcagcgatgcgtttaaatattgttccaattcccgataaagtcttctggatttggtatttgccattcccagtttcaacgtacatcaccactggcattaagggcgtattattatttgtcattttgttcatactttcttggacaatatattatccattctttaagtactatgatgcccagctgttaactaatgagttggagaatagaaagaactagtggatatgaacagcaaatatgatttaacaaatgatgccatgcaaatcattgtatgggctggagatgccaggcaattgattatgacagcactagaaaaaatcgcgcagcatcaattttctaaaacacgatctttattagatgaagctgaatctctattaaataatgcgcacaaaatacaaagtcgttatatgagcttagaagcgtcgggaacacatattccatattctgttttatttaatcatgcgcaagattctttgatgattacaatgagcgagttaaacatggccaaaaaaatgtcaattattatgaaaagtgaagtgaaaaatcatgagtaaaaatcatttcccacaatcctttttatggggtggctcattttcagcgaatcaagccgagggcggatacaaatccgcgggcaaaggtgtatcgcaaacagatcttattccattgaataagtcgtctaaaatcacttcttcatttgaactgaataactgcttagctgatgaaaacagttattttccgaggagaattggtatcgacttttttaaccggtttgatgaggatttggcacttatttcagaattaggcattaactcattacgtatctccattgcatggtctagaatttttcccaatggggatgaaacgacacctaatgaacaggggctagccttttatgaaaaagtgatcgataagcttagtttgttaggcattgaaccagtaatcactatttcacattatgaaatgcccgttaagctaattacaaattatggtggttggaaaaatcgaaaattgattgatttttatactaactatgtgcaaacattactgcacgcatttccagaagttaaatattggcttacatttaatcaaatcaattctgggttaacagatccattttctgcgttgggattactaataaatgattatgcatcaaaagaattgttccaacacgacaagtttcaagccatgcaccaccaattagtggcgacagcaaaagttaaacaaattgcacaacaaatgaattctagtgtcttaattggggctagtgtttacgatatgacatcttatccaagatcccctgaaccaaatgatgtgttgtcgaatcaagaatccattttgatatcagatttttgtagtgatgtactggtacgaggaagatattcaaaatttattttaaattatttcaagaaaaatggtgttgatttagacattacagcggaggatcaacggctattattgcataatacaattgattttcttggaattagttattatgtaaccacggttgttgatcaatcaacgccatccttatttgaaataaatgactggaatattcgcgatgagacatccaataaacacttaaaagctacgaaatggggatgggggattgatccagttggcttacgtattgcattgcggaggtatacagacaagtatccatctatgccaattatgattttagaaaatggattgggagcagaagaaacattatctagtaaaaagaaaattcatgattcttatcgaattgattatctaagaaaacacctttctcagttacaattatcaatacaggaaggcgttaatgtcattggatacttttactggtctccgattgatattgtaagttccggatctggtcaaatgcacaaaagatatggactaatttatgttgacttaaatgattttggtattggcagcggtaagagaataaaaaaggatagtttttattggtacaaacagtatattgaatagaagcagcattgattctagctgatatcagatggtcagttttcaaaaattcactctgtgcgaatatgatatactagtatcagcaaacaagttaagatggtggctatccgaatgcaggtggtgcttatggtgtaaaagctagaggcccagattctaggaaaggagatgcctagtgtccgtttcggatgctgtgcaactaatgttaggctttggaacttttgttctaatgcttctcggattagttgttgagctgataaaaaacagcaataaaaaatgaccatcttagcttggcagagctgatggtcattcaagattattaactttagccaccgtctaaacgggtttgttggagagtcatagtttgcgctatggctcttttcatgtttatattataccacatagttatagtattatggattaacagataaaaaactccataaacgcttatttatcagttagttacttttatatactaaataactataaactgcctactatcaattagttcgcaaatgtactatagttattgtagtgaacaaaacaaataattatagaaatgaggtttcatcatgaaagtaacaatttttggtaaaggcaatatgggacaggcaatcggagctaattttgaaaaatctggcaatgatgtcaactatttaacttcagaggatacagcgacaagtcttagtgaattagttattttggctgtgccttatcctgctttagatacaatcgctcaacaatacaaacaagaattaaaaggaaaagttgttgttgatataacaaatcccttgaactttgagacatggaatgaattagttgttcccgctgatagttcagcagcagaagaactacaaaataagttaccagatagcatagtacttaaagcatttaatacaaattttgctgctacgctacaaagtggaacggttggtggaaatacaacaaccgttttggtggcaggaaatgaggaaggaaagaagctatttaacgacgctttgaatgatagcgacttaaatgttctcgatgcgggtcaacttaatcgagctcgtgaattagaagcaactggttttctacagatgaccttagcagctagtgaacaaattggctggacaggtggcttttcagtcactaagtaaattgcaaaataaaaagcaactatctttaaaatagttgttttttattttgcatatacacccatccgaacaatgtatatgctttaattttattgttccagcaaagcttttcttttgtctggattttcgtcaagatagaaactaccccagtcagccatcgaatcaataactggacgcatactttgtcccaaggttgataaactatactctactttaagaggtactacagcaaagacctgacgaacaacaagaccgtcttcttccatctctctcaaactttgcgttaacattttttgactaataccggccacactaatttttaattctgaaaaacgttttgttccaggtaaaagatcacgaataattaataccttccatttgctgctgagcaggtcaatagtcgttgctacagggcagatgccattttgttctaataattttctagacataatgattatcctttttattttaaaagatactgaaagtgcgtaggttacttttagtatcttttaagtattataggctttctttgataatatggcaaataactacaacatataatcagtcatttttttaaagttgaagtgtactatttgcaatatatatcgtatgcgatataatattatttaggaggttacgatatgaataaagatgaacatctttacgacgaattgtgcttgtcaatatataatacaaatcgttattttcatcatctgtacggttatgtactagaaaaatatgatttatcatatttgcaatatatgagcttactgattatttataaacagaattcggtgaaattaatggatatcggtgccgagcttgagttgtcaagtaatacattgacacctgtaattgagaaacttgtcaataagtcttggattattaaggtgcaaagttcacaggacagacgcgtcaaggttttaaaaatgtctgatcagaaggtaactacttttgaacgcattttgtatgaaatcagaattatgcgtgacaacctaatacatcaaagtggacgtccaattgaagaggtattacgagaaaatcaagcgcttaatcaggtcttaaaaaagatgatacaagaaaaaaagaggtatgaagatgaattatgatgttatttttattggtagtggtcatgctgcatggcacggggcacaaacgttagctcgctcaggaaaaaaaatagccttagtggaagaaaacaaggttgctggtacatgcacaaattttggttgtaatgccaaaatactgttagatggcccagctgaaatgatgcatcatttgaatcattaccatggtatcggaattaatgacacgcccaacatcatttggccagaattaatggcttataagcaccaagtgattgatcctttatcaggcggtttagcacacatgctgtctgttgatggaattgacattattaatgggcacgccaaatttttgaataacgaaaaaattgttgttgttgatcaagtttatcaggctgaaaaatttgtgattgctactggtcaacgacctgcaaaactaccaatttctggttcagagtttatgaaggacagcacagactttctcgacttacctgatatgccaaagtcaattctattcgttggcgctggttatattgcgatggaatttgcttcaattgcacatgccgctgggagtgatgtcactttaattgaatacgggaaccatgttttaaatggatttgataaagtctattctcaaaagctcatcgaggatatgaccgaaaaaggcatccattttacgtttaaccaagctgtttcaagtgtatcgttacttgaaaatgggcaatatcaagttgatacagcgcagggagaaacctattatgttgactacgttatggatacaacaggtcgtgtgcccaatattgaaggattagccttagacgacattaatgttttgtatgataagcaaggtattttagttaacgatcatttacaaacttctattgacaatatttacgccagcggcgatgtaatctctaaagcaataccaagattaacaccaactgctacttttgaatcgaattatattgctagcgtattattaggtaatcaggaacccataaattatcctgtagtgccaacaatcgcttttacattgcctcgtgtagcacaaataggggtaaccattgacgaagcggctaaggatgagaacttacaagttcatgaaattccttatgggagagttatgcgatttcagacactaaacgatgttcacgcagcaattaaaatcgtagtgaataaaaacaaacagctggttggtgcagctttaatcggtgattttgccccagaggttgttaatgcactggttcctgtgattaatcagcagtacacaagttcggacattaagtcgcaaatttatgcgtttccaactgactcaggtattatattgccaatgattgccaattatttagcctaagtaaggaggccttattatgaaagcagcagtgattaatcactatggtggtagagagcagctagaggttatcgacatgcctattcctaaaataaaatcggacgaggttttagtagaaaatatggccacgagtattaatccaattgactacaaagcgcgagagggattattaaaacggatgtttccatggcaattcccggtcattttaggttgggacatcgctggaatagttgcttctactggagatgacgtaacaagttttaaagttggagacccagtgtttgctcggccagatattgacacaaaaggagtgaatggttcgtatgcagaatatacagctgttaaagcggataaactagcactaaaaccaaataacattagctttgttgaggctgcagccgttcctttagctgggctaactgccttgcaaatgcttagaaaacttcagttatcatccaatcagaaaatactaattcaagctggtgctggtggggtaggtatttatgcaattcagctggctaaaatgattggcgcatatgtagtaacaactgctagtcaaaataatcatgaatttgtaaaatctttaggtgcggattctgtaattgattatcacaaaaacaatattcaagatgtgttgtctgatttcgatgctgtgttggacacagttggtgatgttgataatgggattgccatccttaaatccggtggccatcttgtcactatttctaacgcgttaactgaccaacagaaaaacacctcagacaagaccgtgacagaagggtggctaaacccgaacgggcaagatttagcaattttagcatcctacatcgcaaagggtgagcttcaaattgttgtggattctctttatccattaactacagaaggtattcagtcagcccacgagcggagtgaaacacaccacgcccgagggaaagtagtagttcaaattaaagagtaaatacagaggagaaataaatgttcgcttatattatggttacattagttagtctagaggctattggtattatgtttgtagaaatgtttggtacagcttcacagcaggcaaaagcatttgatcttaaagaatctttcgttcagataccagaggttaaaacgttattagcaaatcaaggaatctataatggcttattcggtgcgcttgtaattggtactatgttgtttctatcaggccctcaacaggttttgatgttacagatggaaatgctatttattttcttggctgcagtttatggtgctttaacagccacaaaaaagattatcctggttcagggattgccggcatttattgcaataattttgctatttttgaagtagtctttaaccagctaatattaccagataaaaaaagcgtagcaactgctgcgtttttttttgcaaaaaaatatcaattatagtttaattctagtatgcgctggtaatgttgataaagaatagtgaagcgattaatgctgtgtttatcccaaggtttcggacgaccacaaaaatgtaaaatagatgtattggctatcacccagtttgtatcgacctgacctcggctcttagcaaagtgaacgatgttagctcgcgtatcaaaattccaaatttcttccggtatactcaagatttgattaccatataaataattcaaaatatcttgatcagggagtacgagctctttggcatgatccttaattaggtctaaaatatcacttttattaacttttgcacgcattttgtttaaatctataagcatcacaccagaattaaagtattcacttttagttcgcaatctaacattattaatcgtctgattgattcccgttagacctaaatggcttgctgccgctatcatattaccttttaagtctatcgaccatagtgcttcaattgggttcaatatcaaagtatcagggtctaagtaaattatgcgttctaaatctgctggcagatattcagtgcaaagcaatcggtaatacatttccgttggatattgtttaagcgtgggggcggtttgccaataagttgcgtcaatttttaatgggtgaaaatcataatccagtttgtctgtaaagcctctcaaatggtttatttccgcttctggtatcgaatcgtgtagcagccaaatagaaaatctacaatcaacattcgttgctttcagcgacaagagcataacttttaaaggttttatgtaggacttgtctaaagtgactaaaatgtttatttcttccattattatgagatcctttttttatatgttaagcagtctattaataaaatactttgcaacataaattatacagcatccatactttattagaagtattgagaaaaaagtgactacatcttcatcaattaacataagcttttaatcaccatcaagactaattggtagccattcttaagcaaccatgatatacttaatttgtaattggaaactatcaactagctgtgtcagccaagaagcggctagttgatagttcatcaattcgaaaataaacaatgttacgacgcactcatttcaactgtaggttttaaacgcgccttttttgcgtgcacgaaagttttggctgagaacactctaaatttaaaaactcacactcgaattaatgcgaagaacattaggagagtaagaaaattatgattaaagtccgcgatttgacggtggcctatgatggcacaccggttttcacgaacctatcaattcaatttgagcctggtaaaattaccggtattatcggacctaatggtgcagggaaatcaacaatgattaaaggcattttaggattgataaacaagcagaatggtaaagttacgttacacgacgagccaatcgcaaagcagttaaagaaaatagcttatgtggagcaacgtgctgctttagatttaacttttccaatcaatgtttttgatactgttttaacaggcacataccctaatttgggcctgtttaatgttcccggcacaaaagaaaaagatgccgcaaaggaagcattagaagacgttaagttatctacctttagccaacgacaaattggcgaactctctggtggacaattgcaacgtgttttcgttgcgcgtgcaattgttcaaaatgctgatgtcattattttagatgaaccctttgttggtatagatatgaagtctgaagccgatattatggctatcttaaaacaatggcgcactgcaggaaaaacaattattgttgtacatcacgatttgaataaagtgacaacctattttgataatctggtgattattaatcacggtattactgcatatggggctacagccgatgttttcacaaaagaaaatatcgcctctgcatttagtggtgatctatcatcgatcttgtttgaagaagaggaggatcaacatgcatagtattgaattattcattgacggactaacaaaatataatttcttgcaaacagcattagttacatcgatattagttggtattatgtcaggaattatcgggtccttcatcatattacgaggcatgtctttaatgggtgatgcaatttcgcatgccgtattacctggtgttgcggttgcatacatgctcgggattaatttgttactcggtgcttctgcctttggtattttggcagcattactaatcggtgttgtcacgatgaagtcaaagttgaaaaatgacacagccataggaatcgtattttcagctttcttcgcattgggatttattcttatttcattggcagagtctgctactaatttgcatcacattttatttggaaacgtcttagctgtttctgacagtgatttaattactactgcaatcgtgctttctatagtattattgtttgttgttaccttttacaaagagttacttatcacatcatttgacaatacttttgctaaagcctatggtcttaaaactcaaattatgcattacgctctaatgcttgttttgaccttagttacggtgacagctttgcaaacagtcggaattatcttaattgtggccatgttaattacaccagcagctacggcttacttgttaacaaatcgtatgtctcatatgatgattgttgctgctatcttttctgtaatatcatcaattgtaggcttgtacctgagtttcacatttaactgggcgtcaggtcctgcaattgttcttacagcagcaattttctttacattggcctttatcttttcaccaaaacaaggcattgtcttcaaaagaaagtcttaaaattaaagcagtctaagttaaatagagagaattatcaaagccagcgtatgttacgcagaatatagtggagaaattaaaaatgattaaacgtttaagtattatcgtagtggccgttgttgtcatattgggtggtgtgctgtggtttgttaatagtagtcaagggggaaaaacaagccaacatgataagttgcaagttgttgcgacaaactcaattattggtaacatggttgaagaagttgctggtaataaagtcaacttacacacaattgtgccacgtggtaccgatccacacgaatatgaaccacgaccacaagatgtctcagcagcccaagaggctgacgtactctttcacaatggattaaaccttgaaactggtggttctggctggttcaagaaaatgtatcaaaatgctggaaagaaaacgaataagcaagtgttcgccgtctcaaagggggtagtggctaagcatttaactgataagggtaaagaaaatgaattagacccccatgcttggttagatatgcaaaatggtattaaatatgttaaaaacattgaaaaagtattaattgctaaagacccagacaatgctagcacatataagaagcgcacagcagcatacgttaagaaattatctgcgttagataaaagtgccaaaactaagttcaataatattcctgaaaataagaaattattagttacttctgaaggcgcattcaaatacttctcagcagcttacggtatcacaccagcgtttatttgggaaatcaatacagagtctcaaggtacacctgagcagatgaaacaagtattggagaaaattaaagctactaacgtaccttcattattcgtggaaagctcagtgtctccaaaggcaatggaaaaggtttctaaagaaaccggtctacctatttattcaaaaatttatactgattctttggctaaaaaaggacaggcagcagatacttattacggtatgatgaaatggaacctagataagatttcggaaggtttgtcaaagtaaaacataaatagtgtaaaccttattcataaaaacaccgcaactattcaaatagttacggtgtttttattgttattaagttttagttgtttatctttctgctacatcgatggcttcacgaatattcaatatgtcggcttcatgattattgaaatcaggattatcagtaggcaaagcgatgttgagttcattgaataaatcaattctacctaatacatcgctcgccttgaaatcaagaacatggccgccaatcgtacgatcatcacttaaaaaatgaagatgccacccactcgccataatgccagaataaaggtcaggaccaaaatcaccaattaaagtaccagaaacattttcataattaaacactggttgtttcaatgttacatcaacgaagggtggataaggcttgatttgcttaggagcaacacgaaccttcagtttcgaaaaactagcattcatttgaatactagctggtaaattagcccagctctgatgttgtttggatatattgtttaaactatcaaaagttaaaaatttttcttgaagaaaatagtataactctgattgagaatggatggaagtaaaaggtgtttccaacgataaatctgtgatttctttagttacaccattcgctttcgtttgatatacgctattttctatgattgtaacttcaccatcaagttcatccattgttccaatgccactcgaaccatgattcaatattgacgacaacggtgccgtaccgtcatataatcctgacataattaattctaacgttccatgttgataaattgtagacataatgacctcttttttaattaaagtgttttagttttacttactaaaagtaaaccattttaatatttattcaagattaaaagccactgattacagtggctttagttaacggtaaaatgatgcaacaattagttagtcatgttcatcgagagagtttatcattaggtacttcgaataacacggtgtcattgattttaaaatcgatattattagcagctaagatgtctgtgaaatctttgacatatacatcgctttcaaagctttgcagaatatctactgaaataccaccattaatggctagcatttcaatagataacccatttgttccgctcatataggtatgcatttcatcaatatattgttctaattctcccagtttagtttgaccggaataactaatgatgaaagtattgagaagaatattttcgaagaaagacagcatttgttgcttagcttcaatagtgggtaaggaatctagtttttcaaacagatttgccatttgattaacattggcccttaagttgctgatttgtttgctttgtttaattaagtttctaaattctgtggcaacagctgtaaaatcttcgtcatcaacaataggttgattaactggtaatgcaatgctgccaacacagtttcggaaagtgttttgattagttacgcctaaacgaagatcacttgccatatgagcaacaataggtaattcaaaatcaggataggctttttgaattgcctgcgccataataattgcgacagcgatagcaggtgtagcattatgtttcttagcatatgtcataaaactttcttgatctaagacgatttcatagcgatagctactttttgttgcatcttgacccttggtttctaaaagttggtatccacgatgattcagatcaggcattttattagtttctgaaattggttgggattctaggttctcaagtggctctaacatttcatcttctgacatagtatcgtcgctcaaattaatatgttcaatttctggccaagtattgcttttgtaccctaagtagtaataaagtaacgtttcaacaaatggcataataccgcgtccgtctgcaattgcatgatgataagcaatgaaaatagttttttctgagaaagtaacatcgatgaggtgttggttcacctcatcactacccagagcgcgtagctgatctgtctcagctataattagcgggagatcatttttagataaataatagttggcatctttttcaactaattgactagtcaagtacggatagcgttgcaaggacttatatacagattgttgtaaatacgctgcatcgatatcatcagttaatctaatgtcgattaccatgctaggcgcaccattttggcgatacaaaaatgattgccctgaagtaatcttttcgagttttggtaatgccgataagtaggttttgccgttttctgtcttaaaaatatcttgataagttgtatttaatgtagttgatgttgtcatggttgttctcctttaagatgttgagttattagccatcaactgatgaccatgacaatactataaaattaaaatatttatgttgtatttgaaaaatgttttcaaagtgttaattgtaaaaaatgtttgtttagtttgtgactttgtcagttataattgaactaacaagatcattattaaaaggaaataaatatggctaatattattgttgttgaagacgacccgaatttcaatcgaattttaagtatctatttgtctaaccatggacaccaagttcagagtgctcttagtgcgcaagaggcttatgataagatgtataaccaattgtttgatatgattctttcagatgtgatgatgcctaacattgacggttttgagttcactgagacagtcagaaaaatcaatccgaatattcctattctttttgttactgccaaagatgatattcaatcgaaacaacgtggtttttcatctggtatcgatgattatatggttaaaccaattgatatgtccgaaatgctaatgagggtgactgcgctactacgacgagctcacgtagctaatgatagaaagctaacaatcggcaatacagtacttgatgcagattctgtcagtattatggttgattcacaggaaatttcagtaacggtgcgtgaattcaacattctatttaaattactgtcttatccgaataaaacattttcacgttcacaattacttgatgagttctggggtgttgatacaacgacaggattgcgggcagttgatgtgtacattactaaactgcgtgataaattttctggaagtgatgtctttgaaataacgacagttcatgggttaggatataaagcggttttaaagtaaatgaagaagataaaaaaacacaaaattacttttcaaaaagtatccattaaagagcttattgctgcttatgttatttttttattgtttgctactattccaaatatagttttaatgcatggtggccaactggcattatttacgaacagtaactttatttggtacttgatatattggtttatagtaacattaattttcattggcttaatttcatatcaaaaacatgttctttttgatcaaccagtcagccaattaaatgaagcaacacgacaggttgcacaaggagatttctccgtctatttagaaccaggtcatgcacgcgagaagtacaatgacttagattatgtttttgaaaattttaacttaatgattgaagaacttggtagtacggaaactttaaagaatgactttattgccaatgtatctcatgaatttaaggcgcctctagcagtaattcgaagttatgctgaagctttaaaaaacgaaacagatgaagagcagcgcgacatgtatactcaaatcattgttgacgaaaccgacaaaatggcaacaatggtcaccaatgtattgaaattaagcaagattgaaaaccaagcactccagccacatattaaaaaatataatgtgagtcgtcagctagttgaaacattacttaactttgaaaaaatatgggcatctcacaacatttctttagatattaatattcctgacgatatcgaaattgcagcagatccagaaatgatggagttagtgtggcaaaatctacttagtaatgcgttcaaatttgttccttccggcggacaagtcacattaagactgcaacaaaacaatgaaggaacagaaataacagtccgagataacggtgaaggaatggatcataacacattaaatagaatatttgataaattttatcaaggtgaaacatctcataccaaccaaggaaatggattggggttgtcactagtgaatagaattataactttaatgcaaggatctattagtgtggaaagtaaattgggcaaaggaagcgcttttacagtttggttaccattacatcatttaaacaattaacatggctttaacaattatgttttaagtattttgtataattgtagttgataataatagtggtgaacctgataaggagaaatatgtcgtgtacgaaaaacagtttatcggctacgaataccaagaaagagtagttgaaaaaaaatatgagcctgtctacttggatgcatatccgaattttggctgggtgatcgatcaacatcataaaagtactcaaaatcccaataatatcatgttacatatgaagcgcaatcgtgatcttgtgaaccgtattgaagttaaacgattagaaaataagtttcaagctactatgaatgagattattaaaatcgaaaaacgcaaccaattaataccaacgattcaagcttgtcttgttggcctttttgggactgcacttatagtgggtgcgttctttatacacagtgttagtagtctttatttgtcactcttatttggtttagtcggattcataggatgggtgttgccttattttatttacaagactcagtttgaaaaaagaacacatcataatcaggattctgttgaatctaaatatgatgctatttacgatttaacaaaaagagcacatcaattgtgctacatggattgagaattaaaaatgaacttgcaaacctgttagtgtttgtaagttcatttttttaatttgagtaattaacatttttaaaacaattcgtaaatatttttgaaataaatcatgaatatgatataaccaagataactaactatagttgagtgaggaagacatggtcgataaagttagctattaatatgtatttcgccaacattcacaagtagacatgaaaaggagtttattatgagcaagtcaaaaattgttaaggcaaacaaaaagatagaggagaaggttgtaaaaacttataaaacaattgaaaatggggcagttgaaggatttggtaatatttcagataagttcgtcgataagtacttagccaaagatggcgagtcagctcaagatgctaaaaagcgcattgaagcggaacaaaatcaacgcgaaaaaacaaatatcgacataatcaataaacatcgttaatgaataaaaagcagtatgaccattttaaaagtcatattgctttttatttagcaaaagctacaatttgttcagctatacaaaaataagacgtcatttactgatttggtttaatgtcatgatacaataaaccaaatacaataggttgcgaatgctgtctgaaaagcgaaagggagaattgttttgttaaaaaaatggttaactactgtcttgctaattatcatcactttgttgttggtaaccatagcatatttactatattcaaatcacaacaatattaatacttcaagaagcactgattcttctttcgataccagttcttctagtaaaagctcctccaatgatgatgatttgcttagcttggctaaaataagaagtatattttataaaagataccctaacactgccatcacatcaattgaattagaaaaaaatctattgtcgacgcattatgatattacaggtgtagatgacaatacagaatatacactaaaaattcatgctgataccggtaaagttatcactcacaacaaagaacaattggatgccgatgaaaagaatggcactgccaaaaataatgaagctatagcatttgataacatcatatctttagatagtgccgtaaataaagctaaggatgcggccggcgatggctccttaaatgggtggtctttgggaaaagatgatggtcgtacttattgggaaatttcattaaaagacggaaacaataatgtagcagttaaacttgatgccaatagtggtcaagtgatagaaaaagacgaagatgattaaatattgcaagcttttagtatagttcacttaataatctgctaactatgtggtccttacaaaataataatagttgaaatccgcaacattcttaattaattctcaaaaacccttatgttataatggatagcgtccaatagacatttgtcaaaatttaggggtaacggggaataatggagaaaaatagggatacaaatacgccatcagctactaaaagccgcatggcgttatttcatagtaaaaaacatagttcatttaaattgtatatcgttttagcagctgtcattgtattactatccgcttctggttatgctgcatactatttttatagtttaaataacacacttagtaaatcattttcatcaacaggtcttgattctgaaaaaaaagccacacaattaattcaggataaaaagccagtatctttcttagttttaggaacagatattggcacagagggtggctttggcacgaatcgtagtcgcgtaggattaactgactctatgatggttgtaactgttaatccaaaaaatgaaacaactactttaatttctattccacgagatatcatgacttccatttctgggtttgaaagtagtttccctcagaaattaaatgctgcctatgcgtttaaggcagcttctgataataatgtttcgttgggggacggtgtaagcacaacaatagataccatacaaaaaatgtttaactttccaatcaattatttcgctatggtcaatatgagtggacttggcgatgttgtcgaacaacttggtggcgtgcaagtcaagtcacccttaacgttcacctttagccaagaaactgcccacgaaagtggcaaagatctgtatcaatttactgagggttctagtacattcaaatacgctgctgatggtgaaacctttaaaagctatagtaaaatgaatggacaagcagccttagcgttttctcgaatgcgatatcaagatccaaaaggtgattatggtcgaactgaacgacaacgcttattattgcaacaaattattagtaaagttaagaaaaatccagctcaagtagttaatttaaaattcataaattcgacgactaaaaacattgcttctaatctaaaaccggaagatatgttgaaattaggtactaattacattagtgcctcaaagcatattgtttcatatactgttcaaggacaaggtgagacatttgaaggtatctcataccaacgtgttaccactgcacagcgacaagcaataacaaataaagttagaagcagtttgaacttagaagcagctacaactggaaatgaatttggtagtaatattacagaaaacaatttagctcaagtaggtaccgcagatcaattgtatccagaaaacaatactgacgaaaatatgcagttgcgtgaagagtaaatataaaattagaaaaagacatgttaggtaacatgtcttttttttataaatataattaaaaagcagccttgggagagactgcttttctgggagagaagagaatattatcttatagggagaaagaaaatatattcttatataaatagtggagtatacctctgttaaggtatgtactcataataccgctaaaatgttaaatgaatataaaaatcaggaagaaattgttttccattgagccacgaaataaattaaagaaaggtattgatttatgttgattataagtggtaacatcattgttataatgttagttagctaactaacatttaatgataaagaaggacaatttgtaatgacatctataggtaaattattcaaaattgggcaacgtaatcttgtaagagatcttgatacattggccgtaactcacggggtgactggtgcgcaattgtcggcaattgactttatcgctgacaataagtacgtcacacaaaaagatattgaacaagaatttcatataaaagcttcatctgtagcaactatgatagaccgaatggtagagaaaaaaatggttgcaagagtaccaaatgaaaaagacaaaagagttaatgaaatacacctcacggcgtcaggagcaaaaattaataaaatcgctaaacaaattattagctcccatgatgaagatattttacggcctttttcagaaggtgaacggaaaactataattaaatttttaaaatatgttgcagaagataacagtaatcactcactagaaggagaaaaaaatggaaaataaagtttcaactaaaaatgcaatggctattatagcagtagcgttggtttctttttctggcattatggcagaaacagctatgaacgttacatttcctgttttaacagggtactttagcacatcgctcaattcgatacagtgggtaacgaccgcatacttactctctgtaacaattatgatcacaacaagtgcctatctgaataaaaggtataatacccgttatttatggttagccagccttattttctttgctacaggaactttagtgggcgggttggccagtaatttaccagtattgttaattggccgtgtgttagagggtttagcagcgggtatatcaatgcccctcatgtttaacttgatcgttcaactagtaccaagatcgaagataggcgtatggatgggtatcggttctatggttgtcagtttagccccttcatttggtcctacatacggtggtgctttgattgatactcttggttggcgatcaatatttttcattcttttaattgtgccgattatatcgttgttgttggggtggagaactatcgataacagtaaagaaacacaagccaatgtttcttttgacgtccttgctttcggcttattatctgtgtcattaattacggctttgatattaattaatcaattagaaaatgggactgtcaatatattacttctaggggtcaccattgttagtttaacaggatttgtaattagatcactaacttcaaaacaaacttttttgaacatcagattactcagtaacagtaaatttctattcctgctaattcccgttgttttatatatgtttgcaaatttgggtattaaccttctgctgccaaattattcgcaaaaaatcttaaatacgtcaagcttttgggcaggattctctttattgcctggaacgttactaggtgggatcttaaatccttattttggccatttatatgataagcatggagataaaacgccacttttggtaggaaatacgatctttgggattagtctattggtcatggcctacttcactaaaaatcttggaatcatagcgttcatactcatgtatatgattttcacatttgggcgtaatatggcttttagcattggaatgacagcatctattgatgaattgagtagagataaaaagacggatgccactgctattttacaatcagcgcaaatgtttatgggtgcattaggcactactgttgcagctttatatggcgcacaaaaatcaggcctagctgttgggttccaacatttcctatggttgcttttctttatttcacttgttattttcattatgttctttgctcgacaaaaaacagggaacaaatgaaatctctatattagacagtaaaaaaatagcatgatacaattgtattatgaattaatgtgttttcatatttaacaaccttgcgggagtagcggcgcatgtgcgtgggaaactgacttactagattatttacagtctagcggccaaccttaaacagcaagacgcaaagaatattttctcttaaaggagtgtatcaaaatatgagcacaaagtcgaaagaggtagatgacgacgttccgttatcgttctcagcaaagtttcaccatcaggaatggtctaagatagttaatgatttacatgcaaattatcctagcggactatcagacgaacaagtaaataatcgcttacaaaaaaacggctataatgaggttaatccaaaagttatcccgaagtggttgatttttttgcggcaatttaataatgttattgtctatattttagtggtagctgcgctgttaacgctttttatgcaacattatgcagattcagttgttattgcattagttgtattaattaacgcgttaattggctatttacaagaagtgaatgccagtaatgcgctagataaaataaaaaatatgttgtctgttgaagccactgttattcgagatggtgaacgatttgatgttccagctcgagaattagtacctggtgatttagtctacctagaggccggggataatgtccctgctgatttacgaattatagatgctgataacttacgtattcaagagtcgtctctaacaggagaagctgattctgtcctcaaaaatgaagctattttatccgagcatgtgcccctagccgagcgtagtaacatggcttatgcatcaacagctgtgactaacggtagtgccaccggaatcgtggtaaacactggtgttcattcacagattggccaaatttctcaaagtgttgctgatgtttcagataaaaaatcaccactaacacgagaattagatagtttaggccatggtatttcttggttaattatcgttgtggctatagtcatgtttgccttgggttggtttttcaaaatatatgacatatccaccttgattatggctattattgcaatgattgtcggtgcaatgccggaaggattaccagcagctacgtcaattatattagcaaccggtgttcaaaagttaaccaaaaagaacgcaattgtgaaaacattacctgctgctgaaaccctaggtgcaatagacattattgcgtctgacaaaacagggacattaacaaaaaatgaaatgaccattcaagatattgtcgttggtgaaaatcattatacagtcactgggactggatatgcacccgatggtgacatttttatagggaataagcttgtcgatgcaacacaagacaaaaaccttgaaatgtttttaacaatgggacatcaagcaaatgatacttttttgaccgaagaagcaggtatctggaccatcaacggcgaaccgactgatgctgcctttctgtcggcctactacaaggcctttggacaaaaagtacctaaattaaaagagttggatcgtattccgtttgattctgactaccgatatatggcacgtttagttgaaaataagcatcaacaacgatttgtcgccataaagggtgcgccagacagattattcacactagcccggaaagattcaaattttgactacgagtattggacaaaggtgtcagcaaagtttgccaaatctggaaaacgtgtaattgctgttggatatgttgatgtgaattcagatacatcagaagtccttcacgaaacacttgcagctgaaggcgtgacattcttaggattagccgctattattgacccaccacgacccgaggttgttgatgctattagcgacatgcgcgaggctggtattcgagtcaaaatgattaccggcgatagtccagatacggccaaagcaatcgctcaacaacttggtttggccgaccaaattgaagctgttactggatcagaagttgaagcaatgacggataatcagttggctaaggttgttacaaattatgatgtcttcgcacgaactacaccacaagataagttacgtattatatctgcctatcaagcaaatggattagtaactgccatgactggtgatggtgttaatgatgcgccagcattaaaaaaagctgatattggtgtagcaatggggattaaaggtactgatgttgcgaaagattcggcggatatggtattagctaacgatgatttttcaacgattaaagtggctatcgagcaaggccgacgtttatacgataatattagaaaaacaatcttatatttgttacctactagttttgctgaggggttgattgttgtctttagtatattattgcgccagccaatgcctttaactgcaacgcaattattatggattaacttggtttctgctttgacgttgcaattagcgtttatatttgaaccagctgaaccaggattgatgaaacgcccaccgcgtaaaacaacggccaaattgatgagtcgatacgatgttttccaaatggtttatgtcagtgtcattattgcagcagtggctcttgttgtttttgaacatttagatgatatcacaggttttgcggtagccagtacaatggctgttaacatacttatttttggtaaaattttctatatgtttaatatcagaacagcggctccagcgctaagtaagacattctggacaaacccaatggcattcgtggctatcggtgctatgattattttacagttactatttacgtatgtaccatttatgcaaggtgtattctctacagctgcgttatcgctttctgattggtctttcatcatcttaacaggattgattgttctaatcgtaacagaattagataagtatcgtcggatgactgtaaaacgatagtatataaataaagttattattaaaaaaatggcaatcacaacttaactgacctgtgattgttatttttttgtgatgaaaaccttataaaaaaatcacattgaaggaatgactctttctgaaaaaaactttttaacttaatttaacctgatatcgatataatcaagctagtaactaaactataaaaggcaggatcaagctatggttaaaaattcaactactgagtatacttttataaaagctcaaattgatctggttattcataatattgttagtaataaatacaatgaggaactgacatactacgatgttttatggcttcctgataatttaaccaacccagacagcaaagagctatggcaatcatttcaagataatttagaaaaaatttcttttatagctatgaatactggtttgccgaaccccaatgccgatgtcgatttggtaatcgttaaaatgagtagtggtgaaataaatccaaatgcgataaaatattttgaagtaggtaagcgaaaagattatttagcgatgcaatacccgcatataatggacaaagacaacgacactttatttaatgcttgggatgaggctaacaactcgtataattcaaaggaaacatccgcaaccgtttgaattttaagtgactatctgatcggaaataccagattcaaataaaaaaacaactgtcactgaatagttgtttttatttaccagctatttcaatttctattcgaaaaaactattgacttgaagtccactccaagggttacacttaatgtattcactagtaaaaaaggagattatcatggattacaagacattagctagtggcattgagatgcccttactgggatttggtgtttttcaagttcaagaaaaaggggctgccaaacaagcagtactcaatgccatcaaaacaggttatcgattaattgatacagcggccagttatggtaatgagcgagaagttggcgaagcgattttggaagcaatcaatcaaggcatagtaaaacgtgaggaattattcgtcacatcaaagatgtgggttcaagatgtttctgcacagcaggcaactgccgccatccaatcttcattacaacgtttaaatttagattacttagatttatacttgatacaccaaccttataatgacgtatttggtgcgtggcgagcaatggaatctgcgtatcgatccggccagttaaaagctatcggggtctcaaattttgatattgcacagttaactaacttagcagagttttccgatataaaaccgatgctaaaccaaatcgaggtaaacccatttcagtaaaataagaaggacattacgtactttagtcaatacggtgttcaggtcgaagcttgggcaccatttgcagaaggtaaaaatgatctgttttcaaatattctactgcggaaaattgctgacaaacatcataaatcgattgcacaaattgtacttcgttggctaacacaacgaaatattatagtagttgctaaatctgttaagccggaaagaatggcgcaaaatcttgacatttttgattttaaattaacgcaccaagaattagcagaaattgaaacattagatacgaatagtagccagttttttaatcatgcagatccggacatgattaaatggatggctaaccgtgaaattagttatgatgttacatttgactagctgagctggaggtgttgctaatgaatatcaaaaaagttgctgaaataactaaactatcagcagatacaattcggtattacgagcgtattggtattattggtccggtacctagacaagaaaatggtattagaaattttaatgatcgtagtttaaatcagttaaaatttgtaaaaatcatgagaaacgctggtatgagtattgaggcattgaagcagtacatcgatttaatatatgaagacaatgatgctacaatacctgcccgcaaagccatgttagtagaagcagctaatgagatgaccgaaaaaattaataatttagtgaccgctcgtagttatctcactaataagatagataactattacggccatatgcgtacagttgaaaacaaactgtttcacgataaatgatgtttactatatattagccagaatgcgagataaaagggtttgaaattcctgttttaattaagatattttaacacgtgaatattgaaaaatatatgtaataatttgttgctttacataccgaccaggcagtatatactaaagatatcaattattcaaggagtacaaaaaatgtctgttgaaaacgttcgtcaatttttcaaaaaatatcatttagagaaccgaatcgtagaacacgagaacattggtgatacggttgaacacgctgccgagttgttgaagtgtgagataaaacaaattgccaaatccatgaccttcatcgtggcagaaaattcaattttgattgttcttgcaggtgacaaaaaagtagataatagaaaattcaaatcaacgtacaattcacgaccaaaaatgattccttttgatcaggttgcggacagaattggacacatccctggtgcggtaacaccatttgcaatcaaatcagacgtaaaagtatacttagacgtatctctaaagagatttgaaactgtttttgctgcaggcggtagtacaaatagtacaatcgaattatcaatagatgagcttgaaaactatgctcatcccctagactgggtagatgtagggaaagactagtgaacacacttgctaaacaaaccgtttagcgagtgcgaacgggaggcaatcaatacgaatgacagtaaatgattggataacctttatattagctagtaccgttattataatttccccaggtccttctgtaatatatgtaacaacaaacagtatgactaatgagattaaaacaatgatgccattgattataggactcactgcaggatatttttgtggtatgggcatctctttaatatttataagtagcttactcaaaatttcatcctactcattggtcgtgttaaaaataattggttctggctatttaacgtacttagccatccaaatgtggactcgtaagcagattaatcaagatagcagaaaaccaacattcatacgaggtgtgctcattgctatcagtaatcctaaggcactattattttatacaacttttttcccgcaatttggtcatactcaagttgatatggtatatctagcactatgttatggcatattaagttttatagtggatttttcgaatatgctaatttctcattttgttagcagagaaattagcatgaactctttaatgtggattaatcgatccggagcattattgctatggcttactactttaaagatctggctgtgaataaccagaagttagttccaactgttttttttagcacatttaaccaataacgtttttggcttctcctgataaatatgcatttaaattatctacggttatgcgtaataatctttcacgagtctctaatggtgcccaagcgatgtgaggtgtaataaagcaatttttagcttttaataaaggattgtctttttcaattggctctttttggacaacatctgtagctaaggcataaactttttcattatttagtgcctcggctatgtcattttcactaataagttttccacgggctgtattgattaaaatcacaccatctttcatttttgagatagtagtcttgttaattaaattaatcgtttctggtgtttgaacaacatgaagactaataatatccgctttttggaaaagctcatctaaagaaacttggttgacccatttttgggttgcaacaataggtcgatgattataaaaaataactttcattgaaaaagcattggctaattctgccactttttgagcaattcgaccataaccaatgagccctaatgttttacctttcaattcaaatagcggtttatcccaaaatgtaaaatcatcgacactagaccatttcccatcatggaccaattggttatgtaatccaacctgaccagttatttctagtaataatgaaaaggtaaattgcgcgacagcatccgtagcataagtaggcacattcgtcacaataatgttgtggttgtttgcactatcaatatcgacaacgtcataacctgttcccataatgccaatatattttaactgtgaagcacgactgattacactatcatctagtggggtcttatgtgttatcacaacttccgcatcatcgattctctgcaaaatttcagtgtcattatctactgatgtacggctataaaactcaaagtcgcccaaattttttaacgtttcccaatttaaatcttgattgagatcataaccatctaaaagtacaattttcataacttatatctccgtttttttgagccatttgaataaatcttttactacaaggatctgaaaagtaatttagtcatattttatcacttatgactaaccatgatttttaaacttgaagactaagaataggggattgtcgcaagaattatttcgtgaatatcaacaccgcggggttttgagtccttaaccggctcaattaaaataaagtggtaaaatgaaacagatgaacgctaattgtttgttatcatatgatttcagacggagttccggcgcggatgcttatcatataggaggaaactaaatgtcaaggaatgaagaaaaaatttggcttgtaacgggtggatcaactggatttggacgtaaattaattgaagaattaattgcaaaaaagattccagtcgtagctaccgcaagaaatttatcagcatttaatgatttagaaacgaatgaggatgatttgctacttaaagtacaattggatgtcacaaaccaagaacaagtcaacaatgctgtccagtcagtgctcaataagtttggaaaaattgatgttctggttaataacgctggctacggatactcaggttcgatagaagaatcagatgaaactgcagtccgccaaatgtttgaagcaaatttttggggagctagtgcgatgattcgtgcagtgttaccagctatgagaaaaaacagatcaggattaattatcaatgtcacatcaataggtggtttactagcgttacccacctatggttattacaatgcaaccaagcatgccttagagggattaggtaaggcactatcattagaagttgaaccttttggtattaaggtaacaaatgtcgagcctggtccctttagaactgattgggcaggcagatcacaattttctgccaaacattcaattaacgattatgaaaatacgccagcaagaacatctgaggaagcttcacatgccagatcaggcgaacaaactggctctcctgaactagctgcaaaggcatttattaaaatcgctgcctctgacaatccgcctttgcattttattgccggtcaaaatgcttttaaacgtgaacaagaagaaatttctaatattcaacatgatatgcaaaaatggcaagaggattcaacccatctggactatggtgacgagacctattggcaatagatgggggaatttatgggatcgtttattaaaaaatgacgcatacaatgattatattttttattaccactacttttcttagagctctaaaactaaggctaagcgtttctttttaatacacttgacatagtttcgaaaagataacttaagtatttaatttatcttttttatttttttatttttttatttttttaaaattctaaaaaaattaagtgatatggtatggtgtataatcagttggttaacactagataaaaagggggaaataataatgaattcgttagatacgtttattactaaaaatgattcactaaaaatggatttaatgaattattttttagaaacagatcaaagtttatacacaatgaaaagcattgaaaataacttcgcattatcgacatatatgttgcgtgaaacaatagaagccttaaatattgatattaataatttatttaagtttgattggctgctgattaaaaaaggtattatctatcaaaagtatcgcgtcagcaggtatcatctctacaaattgtctcaattttattttaatttgtcgcctctaaaaatacttttggaaaaacgatcactttcaggatcaattcccacctacacaaatattcagtcagaatatggatggagtacttcctattttttcacacaaaaaaataccttaaacagtatgattatggatcaaaatccttttgaatttattcaggcaggttatgcaatttacaactactttgatgagaaaccagctttttctaatcgtataaaatctattagtcaagacattatagattttttattagatacataccttgtgaatgatatgaaccttcaacaaaaagaattacttattaacttttatgtttcggaaatgattaacaatggacgttactgcttaacaaactatagtgaaccagtaatctatacattacaaaaattaccagattcaatagcactacaagtaagtggtgacaccactatctttttatccaaattgctagaagttttagatttgtttgattttctacaagaaagtaatctgtactggttctctcctgaaattgaagataaaattttaaaagtgcaacaaaaaattacgccgttattgtcacgttatttcaagactttaagtttttcaaaaattagtttattaggtcatcaaatctcaaaatatagtcaacgatttagtatgaaaacgcagtggtttttcaaaccagaaggtgttgttaacctaaaatactttcaggatatttatccttcaatttttacattattaccagaaataattaaaatacttaacgatcaacaaactataatctttgatagtcggcaaaatttatttgaatttaatcttattggaattatgtttaacgatattgcagctatcaatcttgacaagatagaaatcagtgttaatttcacagccacacaaatgacaaacaatatgattattacaatgttaaaaagtcatattaatcacgcgagcgtgtacttcacacaaaaccagaccaatgcggatatttatttatctgacacaattgatgaaaaatcaagaggagagcaagtaatttggaaaaagccgcctaccttaagtgactggagagcattgggagaactaattgtaaagataaagaaaaatgaaaagaaaaaaacttaacattaacaaactagtttacacaagcaccttatcaattttattgatatcaattaactcaactttgaggcatcctctcattacggctaacaagatcactttaagagagctcattaataatgataatacgttaaatcagctagtaataaacggagatgcttttgttgataataatattattacattgacaccggataaacagtccatgtctgggaccgcttatttaaaaacaccgattaacttttctaatgatgttttgttaagtttaaaagtaaacgttggcgataaatctcagcaaagaaacggtggagatggcattgctgttagttttgtaccatatgatcaaattaatttactaaatcaaaaacatggcggcgctttagggctcggaggcataaaaaatgtgtttggttttaaggtagacacatactttaaccaagttggtgagacaggaatttttgatccagatccttctaaatttgggttttcacaaggttctggtgtaccatttggtgcatttttttctggaacaagtgaaggcgtcattcagacgttatctgaaggagctcaatctcttgatcaaaaaatttatggcaatcaacttgaagacctgactatctcttatgatagtaacaatcgtttgtttcaaattaactatcatggaaaaacttggaatcattcaattaaaaatgctaatgaactagacaaaccgatgtatttagttttttcctcttctactgggacaaaccataatttgcaacaaatattacttgataccacagacttcaaaccttacacgtcaactgtaactgttaattatttagatgaaagtaataaaaaaattgcaccttcagaaactttgacaggtacgcctaatgaaaaatatactaccaatgagaaaaaaattgagggttatgaattgatcgagaaaccaaataataactcaggcatattttcaggtagtagttcagaggttaattattactacaaaccaattacccatcaaattattatcgattatatgtataacaattattcattacgaaaagaaatattaacaggtaatactggcgagactattaaccatgcaagtactactacgctatctgttttaaaagactacacaattgattcttccgattggccaggaagtttctccattcctaatagtgaccagaaagcatggcactttaaaatctggctatccaaaaaagctgcatctgttactaaaaataacgacagtgtgaaggtagatgtggaaaagataaatagcactaatatagtgacaaaagatccaattgttacgagctatttctctgaaaggtattcaagtgaaattatcaaaaaatacctattccaaaaattatttactaatacttctaaaaaatatgtacaaatagagcatccgtctattgttcttgacaggatagcagataactattcaaacttagataagtattttgttagtattaataatcaaaaagaaaaaactactgctataagtacaacagaccttatgaatattgatcaagtagcatttcgtgataatttcattagtcgaaacataaagcctagcccttttagtgtaaaggtaagtgattttacaaaagtattaaatgttatggcatcgtacacaacttttacggatagataaaagcgttataatacgcttttttatttttcattttttgcaaaatagaaaagaatatattaatgggataactatatataataactactggtcaaatattttatatatgggagtaatcatgggaaaacgcatctatcaaattgacagtatcaaggtctttgcaatattctctgttgtatcagttcattttcttcttaattcggggttttatgatattgacattgagtctttattagcgtcaattggtactgttttgagattaattttcatcactgcggtgccactgtttatcatgtcaacaggttttttaatgggagaaaaaactctagatgatacgtatgttacaaaacttggtaaggtattgttgatatacattgttgtatcattgattgattggattggacatattttaattctacataatgacttttcattttctgatgccttatttggactattggattattcaactgacagctatggctggtatgtagaaatgtatattggattgtatttaattattcctctgttaaatgctgcttggcataatagcgaggataaacgatatcatttatatattgtagtaacatcgactatattattcttcttaccttcactatttaacatttttgggaaaatattaccagattggtggacagctgcttatcctatcggatactactaccttgggctctattttaaaacttacttggaacaaataaaaacaattcgtgtaaaatcattacttttttattctggaacagtgtttatttttctatccattttgacgttattaaaaaattatggtgggatcttttcttggacaacgcaaaatgattatatggggtatcaaccatttattgtgtcaatcattatttttttattatttttgaaattgccttttaaagatgaaaaaaatggctcatttcactttttgttggtaaagatatcaaatatgacattaaccatttatcttttttcggacttaactgacagcatagtgtattactattttaagcaattcgtgccaaacatagaagcacggtttgtatgggcaccagttattgtttgcatatcttttactatggcgcttatgttatctttttcagttgagataattttatcaaaaacaattttcaatagaataagaggagaaaaatcatgatttttttgtcgaatgttttgcaattctacacatcgtattatccaattattatgactattgtttggttactgggatcatggatttctggaattcgaatttctaaaacaaaacaacaatgtgtgaaaaatgataaagttactatacttttatcaatgttcaatgaagaagaaaatattattgaaacgttacagtcatttactcatttagaatattctaattttgatgttgttattgttgatgataaaagtaatgatcattctgtcaaaattgtcaaaaaatggttaaatgaccaagtaaaaataacagttaatttgattgaattatctcaaaatattggtaaggcgcaagcactaaatgaagcaatcaaacaaattgattcaccgtacatcttagtaacagatgctgattctttgttagctagtaatgcaatcaataaattattgcaaggtgtaactaatgaaagagttgctgctgtcaccggtaaaccaattgtcagaaatcgaacaacattacttggcagattacaagcattagagtatgtaggtatcattgatagaataaaacgagctcaggacaatttatatggcggtatcatgaccgtcgcaggagttgttgtattgtaccgaaaaaaagcgttattatcagtaaatggatttgatcgtacagctatcactgaagatattgatattacttggcgattaagaaaaaatcaatggctcattagatatacacctgaatcgttagcttatatattagtacccgagacttttcaaggatactttaaacaacgtattcgttggtcaataggtggactggaagtatttttaaaaaacataaaatgggtagttaagcagggaagtacttatcaaagaatgttgttacttgacatgtttttaagtcacatttgggcctggttggcagtcataacattgtgccaatacgttctattaaccgttacaaccaaaacattttcattgcctggtggcatattgatcctatacatttctctcttttttatcatgttttttcaaggcctaattcaagataaaggtcaatcaatgcttactgtacaggatatctttgcgttgccattttatagcaccttttactggttcacatcactaataacagcaattatttcacagtttaatattgccttttttcacaaacagaaaggttcttggaaaagtccagatcgagggagataaaaatgatgtcagaaattataattcgtcgtaaaaatatgatagggaatacaatatcaaacataattactttggtagcttgggggcttaatttgtttataattttgctcgccttaataacacaatgggggatttactcggatagctttgtggttgttcagctattattaggcctgaatacacgtgttatcaatggagggttacaaacaattatgatttgtataactttaatactattaccaacactcagatctttattatcaaaaagagaggatatttaaagtgaaaagaacaagtcgaatgtcagtgctgatagttatatgtattatgattagtctcttttttttaatgacctttgttgtttttaaacaagaacatcaacaagaaaaaattgatcagaaagttgattatacatatcgtgattttgcacaaaagaataagaatgttaaggatggtgtaattgttttagcctaccatcgtattttaaaaaataataaaacagttgactttgcaaaaaaagtttccaaaaatccgcagttgcaacaatacaatgttgctcaaaatgaatttattcgtcaaatgaaatggttgaagaaaaataatgttagcgtttggtcaacagatgaactaatcaaacattctagagaaaataatatcaaaggaaaacatgttgttttaacatttgacgatattgatacgacattaccgcgtaatgcagctcagacaatgttcaacttcagttttccgtttactatttttgtaatcacaggacaagcggggagaaatttagacggtgagcaaatggcaacgtggtcagaaattgctagattggctgaacataaggaagttacagttggtttacacaccaatgatttacattatcaagttaataatcatccaattttatcaagtggtaaactatcaaaacatacaatactagaagactataaaaaatcacaacaaaaaatgaagaaagaagtatcagtcaatacgcatgtgtttgcctatccttatgggagtgaaaataagacactgacagaatatatgtacttacacggtatgaatggtatttttcttttagaacctggtgttgtgacgaatgatatgcctgatattttaaaacgcataccaaggtttatcgtaacagattcgaattttaatcagttggggaaatggtttaattcaagataaaaaattataaaaataataattttagttggttgataatatgataacaaatttttcagttaatgtttttaaaagaaagtacaatacatttctttctaactattgtgtatcagatgtaaaatggatacatataaataaccacttagaagtttattttctcgaaagtaacgagtattcagttgagccagtgcatatccgctggcaaattaaaaatggtgttgtactgcataattcaaaaagagtattacgattttgaatattaatacttattgtcagttcaaatcacagtatttagcgacgtcattttcgttctatagggcataatcatcgttatggtgtaaaagcataactatttttttcagatttagaattagtctattacttttagcactcgtttcatgttatattgttacgtaaatgttccaacactttactgttactaatacaatagttctaatagaaaatatcacttagaatgacagtaatttcgaaagataaattagttattagacctttaaaaataaaagattacggcagttggtttactggattttctccacgtaagcccacccagatccattttgatgagaggttgttagatatgagtatttgcactcaagaatggtttggtaatttacttggaaaacaccaaaaattaaaagacactgatgatacatatattttgaaaggttttaaaaagcataatgtccgaaacaattaatcaatcaaaacattattatggtcgatcacaatcacaatttggcgatctttgtattcccgtacaaagcaaaaaggagaaattaccaattgttgtaacaatacatggtggcttttggttgaatcaatatggcttagaagaactcaatccaatttgtaccaatcttaatcaattaggttttgctacttggaatattgaacatagacgtctaggtgagctagacggtgggttcccagcacctacaatgatgttatcaacagcattaactttgttaaaaagctagctgaaaggtatcctattgatatttcgcgtgttatcctaatggggcactcagcgggaggtcacctcgcactttggagtactgctactatttttaatcaaagcttaaaaaacgatactaaattgattcctctcgaaatagcaccaacactggttgtttcactcgcaggtatttctattttagaggacgcaaaaaaacgttttgaaactaaggagggaccaaacttagtcacaaacattataggatcaagtgatatcaactcggtgtcacccaataagcttcttcccctaggcattcccatcataatggttcatggtttggatgacgcggacgttgatccaaaaatgaccaaaaaatttggttctgaagctgagaatttaggcgatgatgtatcctatgtaattatggaatcagcaaatcatttcgacctgattgatccgaaaacacctatttggaaaagtacaattgcgactattcgtaacaaaatttagatctttaaatttcaaatcataaaagttaacctagttgtcttatcctgattatcaggatttttttattttacgaacaattacatttttgttgttacaatgaatactttctcccattcgatggcctcttagcgtctgaaatggtgctataattacacttaatattatttttatgacataatcatgggttagaaagcgtaaaactgcaatgaataaactactattgactgcttacgggttctcaacagataaaatcaaacgtgctgcactaggattgcttaatatagaacattctagtaaagcatgtattatatctacttctagaccagaagaaaaagagaagcatccacaaatgcaataaatcagaaatgatttattagaatttagactagatcaggttaattttcttgatgtgcagtttgaaagtgcaaagaaactatatggctatgacttgatattcttgaatggtggttatccattttatctactacatttcttgaaaaaaagtggtgctgaccatattttaaaagacattagtaggactggggttccaatttttgggctaagtgctggatcaattgtaatgggaccttccatcgaatatttgcaatatctttatccagaggataaccaatttaatgatacagatttaacaggtttgaacttaacaagtactacaattttcccgcacttcaaagaaatgttaacgcgtgatgctgatattgacaaaaaactaacttcgtatgaaaatacaactggagttaaaatcatgaggcttaataatgatcaagccttatcgtgtcattgcaaagataaagttctgattgattaaataccgaattggaaaccctatatatcaaataacgatttaatctcaaaatcctaacttttcgcgttatactcaacttcttttaaagaatagtggaacaggggttgtgctgaaaaaattacagatacgctcaatacagaactcgaatcattaattgacaattcactatcatccatttaaactttacttataaataataagttgaggaaaagaatttgttcaataaaaaattaagatcgtattcttttcgtctttgtttgtctattgttggcaccattatcattgcctttgggattgttttattccgtttggcgaacatgggcattgatccagcaacagcagcagatgttggtatatcagataccttccattggaatttagggaactatcagcttgcatttaatgcgctattgttccttggcattttgtttttcgatcaaacacagtttggcatcggaacattaatcaatatgtcgttaccaggatacattatcgcttattttacaccgaagtttgaacctatagttgggcgttggtttggatgcttttcttatcttgaaaacatatttttatttgtcattggtatgtttttattttcattaggaattggcatatatacaagtgtaaatcttggtgtttccccgtacgatgcagttgcgccattgttcaacaaaaagaaatgggccagttatcgtctgacaaggtctgttcaagatttgttcttttttgtagttgccattatatttggtgggccactgggtattggaacttttttgattgccacgttaactggctatattgtacaatactggcgtcagctatttaaaaaaataaaacaccacatacaaaaaacgcacagcttttagttgtgcgtttcgtcattcaaaaattaaatacaatttatcctcttgccaaacagaacgtttgttcgtataatgaattatacagcttttgttttggagacagcatatggtaaacaagcagaaaattgaatacaactacacgcaagaggaacgacgtgtgatatttatgattgattctaaaagcttttatgccagtgttgagtgtgtggaacgtaactacaatccattaaaagcattacttgttgtgatgtcagaacaagaaaataccaacggcggcttagtcttggcatcttcaccaatggccaagaaaatactgggtatcactaatgttacccgacaacgtgatattcctgtttgtccggacttagtgattgctcatccgagaatgaacctttatattcaagaaaatctacgtattaataacatctatcgacaatacactgatgatgcgcacttattgccatattccattgatgaatccatccttgatatgacacattcttggcaactatttggtaaaacaccagcagaagttgctttcaaaatacaaaagcaagttcgggcagaaacaggtatctatttaactgttggtattggtgattcaccagtcttggccaaattagcgcttgatattgaagccaaacatgctaagaatctgacaggaatctggcattatgaagatgtgccacggaagctatggccaattactaaactaactgatgtttggagtattggctcgcgaactgcgcgtaagctaaatttgatgggtattcactcaatgtatgacttatctcaccaagatccatatctatttcgttcgaaactgggattaatgggtgaacagttgttagctttgtcttggggtattgaccgatctgagctgactgaaacaatcaggcccaaaaataaatcatatagtaattctcaagttttaccacgtgattacagccaacaagctgagattgaaatcgtgattcgagaaatggcggatcaagttgccacaagaattcgtgcccaccaaaagcaaacttgcttagttagcttgtttattggttattctttttctgaaagtgagaaacaagaatcacatggctttagaaaacaatgtcgtattagtcccaccaacgataccaatgcattaatggctgttatgatcaacctcttcagaaagcactggcgaggcgagattattagacacatcgggattgattacggtggcctagttgatgatactggagtacagcttaatctttttgaacaacctgaacacatccttaaaacaaacaaaattgatcaagttgtcgacgaaattcgtcaacgctttggtactacagctttgatgcgggctatgtctaaagaagtcggtggaacagccattaaccgagctagtttagttggcggacacaacggaggcaacagttatgactgacaatgatgatttcactacgataatcaatcgctacttccaaaacgattaccgagaacgagggaaaattaaatggaacggctactttctgtccgaccacacttcttctttaaccaaagagggcattcaacgaaatacaataactaagaaattacccgcaatatcactaaatgatgcgcaagatattttacgacacgcttctgctaattatcatgccgtaaccgttcaacaaaatattaaagataacgaaggaaatctgatccctaatgtgactggtttaataaatggtttttccgaattaggtgtctatattgaccaccaattcatagcctttgaagacattagaacagtggtaagaaaaaatgaatccaattgaaaatattatcgcagagattaattctttattcactaaacaacctaatactatttatgaagtacgattggttaatcaacgatatgctaaaaaagttaatgtgttctttgaatattatcggattggacatgcgactcattcacagcagattgctcgtttaaatgatgaatatcgatctcaaataccagagttagcgacaatgattcatcaggctactggcctgacggttaacaccaactaatttattcgtgaattaattatcatctaaagttgtttttagattcaatatgctctatactattcgtcttataaacacttcagcctcggtagatagggtgattacaataattaattgaataatgtttgctccttcaaatccgagtattactgttagctacttcactaatttgatattctatcctagttgatatagaatttagttatcataatgaaagcgcttacaacgtttttgtttttaggaggccaggttagaatgtcagataaaaaaatatcagctgggttagcagctttgaaggtcatggaaggatgggctgttcatactatatatggtattccttccggaacattaagcgggttgatggatgctatgggacatcctgaaaataatattaagtttttgcaagttaaacatgaagaagttgctgcaatggctgccgtgatgcaatggaaattcggtggaaaattaggcgtcgctgttggatcaggtggtccaggggctactcatttgattaatggcttatatgatgcagctatggataatacgcctgtattagcaattttggggtcaaagccagttcgtgaattaaacatggattccttccaagaattaaatcaaaatccaatgtatgaaagtatcgctgtttacaatcgtcgcgtagctactgccgaacaattgcctcatttggttgatgatgcaatccgtacggcgattgccaagcgtggtgtggctgttcttgaagtacctgcagattttggattttcacaaattgatgccaattcgatttattcaacaccactgtattcatcaggcccaaagtataaagaatacaaatcagcacctgtcgataatgctgatattgatgctgctgttgaactattaaaccaagcaaaacaaccagttatttatgctggtgtgggtaccatgggtcatggctcagctgtacaagcattatctcgcaaaataaaggcgcccattatcacgaccggtaaaaactttgaaacttttgactgggactttgaggcctttgcaggttcaaatttccgagtagggtggaagccagccaacgaagctgttctcgaagctgacactgtattatttgttggaacaaacttcccattttcagaagttgaagggacattccgtaacgttgacaagtttatccaaattgataacaatcctgcaatgctaggtaaacgccatcaaaatgatgttgccatcctcggtgatgctggtgaagcaattgatgaaatacttgccaaggtttcctcggtttcagaatcatcttggtggcaggctaacattaaaaatatacagaactggcgcgattatatgaccaaacttgaaaaaaagaccgagggcgacctacaagcttaccaagtttataatgcaattaatgagcatgcagcagataacgctattttctcaattgatgttggtaacgtaacacagctatcagttcgtcatttgcacatgacacctaaaaatatgtggcgcacgtcaccattgtttgcgtcaatgggtattggtctaccgggaggtattggtgccaagaacacttatccagatcgtcaagtttggaatttgataggtgatggtgccttttcaatgacatatccagatgttgtgacaaatgttcgctacaacttaccagtcatcaatgttgtatttaccaatacggaatatggcttcatcaaaaataagtacgaagatactaacacctacaacttcggcgttgactttacagatgttgattatgccaaaatagccgaagcccaaggggcgattggattgacagtaagtcgcattgaagatattgatcgcgtcgttcaggaagcgcttagctattatggtaaaggccgtgtcgtggtgattgatgcaaaaatcactaaggatcgtccaatccctgttgaaacattgaagttagataaaagtttgtatagtgcagaaactgttaatgcttataaagaaaaatacgaagcgcaggaactcgtcccattccgtgagtatttggaatcagagggactaacttcaaaatatattaaagacagtaatgacaataagtacagtttctaacaagatacgttttgatgtttaaatgcattttgtttataccttgccaccaccaatccaatctataatgctaactagtatgtatcatttgacaaaatttatagacgatactataacatagttgtagacataaaaattttgatggaggtgtaaatatgtcaaacaatttaatgcaacgttttagttctgatgatatttttgattttatgaatcaggctatgcatccttggtccgatcaacgtttactaccaaagtcgatcaagactgatgtgattgagaaagaggatcgtttcaccgttactgcagaattagctggggtaaacaaagacgacatcaacattgattacaagaatgaccaacttttgattagtgctaaacgtgatgaattcaaggatcacactgatcatgacggtaatattttgcagagtgaacggacatacggatctgtgtcccgtgcttactatttgccaggggtggactcaagcaagattacagcaaaattcgcaaatggcgaattgcgcgttgaattgcctaagcaagcaactgaacaatcaagtactaatattaagattgactgatctataattcggtgtttctattaattcgtcctttgtattagccgttgaggcattaattgatacaagtaaaaaagctcgtccggatggatgagcttttttgtattgggcatccacttatatcaaagacttcatgacttattagatgctttctaaagcttcaaatataggtgtatcaccatcactcatttttataacttgatttattgttgaattgtgattcaaaatgtccgctaatgttgcgccaacattttgaattgaattcttcgttagcgccttatcattcaagctaattttattggttcctggtatgtctacgagtgcagttgcttgtaaaatcgtataattaagtttcgtttgtttcacaagataattatccgcaaaaaatttagcgatattataattcatcaaatcagccattgctggattatgccatttattaggttcaagtgaatatgctgagctcagcatgatatatctagaaacaccattcgattcagctatattcattgacttgactgcaccaaaagcatctgtttgtaacaagtctttattgcgcgatccggctacaaaataaattgcgtcaatgtcttcaactttttgagataaggtttcaatatcatcatgtaaatcaaaattgatcgcagtgatatttttgtgtttcattgtcctttcggggtttcgtgatccagctatgatttcgtgatgttgattaatcaggtgcttgattaactcttgaccaacacgaccattagcaccaataacaaatattttcattttttatttcctcaaattaggctcatttttgaacataccttactatatgtgagtttaacataatttatatttttgtgttgctaagcactttcatttagaaaatgaataactggcttaagaattaaatatggtgttcacttttgaaagaacgataaaaagattttgtgaatgatttttgaggacgagacaattgtataatcctttgactttcccctccagatagatgatgattttttcccttacatataaatggtcaccacttacatttacacactgacctgtcgtcaagtatttttacctcttgtcgtaattcttatctcaacagttatatttttcagtatgatattgagtgttgaaagatatttctaatgtagaaattttgttgatccggtttgtttgttgtgtaaattgtcatttcacactaaccaaaatttatgtaaagaagggaagtatcatcatggctgatatactaaaatttattttcgaaatcattaacaacacaccgttctgggtatgggttgttttaattatactaattaaacgaggtacgtcattaataaatgacagtcctgcttctattggaagatcaatcataatgccttttattttcgttatttggggtctaaatacagtagtaaacaaatttgcttctccaaatactttgctgagtttttacctggtggcattgattttaggatttttgttcagttacttactttatatgcgacgatctttttatgttgaagatggccaattaattcaggagggtagtaccttacctttagttattatgctaaccaattttctagtaaaatatattctaaacgttattctcgctatccatccagtactttacactcagatgaatttcaacattttttatggtattgtttctgggttcacagttggattattctttggcggcatttataaaacgcttacggcaaagaaacaatttttgaagtcatagtgaaaggagatattccagttcccaagatcatgctcaattacaccatcgtaaccgtaaaacataaacaaaggttcatgtaagtaattacgcgtgtcttttgacagaggtttcaaaataagatatactcggttaataattgaatagtaaataactaggggcgccaattggctgagaagaaccctttgaacctgagatggataatgccagcggaggaaagtgaattgtgtgatgcaacagtaacttgttagcaatacatatttaaagcaatttttgagcacttttgtccgctgacaaaagtgctttttttgtggaggtaaagcatggatttaacaaaagttactcaacaaattgcgtcgcagcaagatgatttattagaattggtaaagcagttggttgcttttgagaccccagcgccaccagcgcgtaacacacgtgaggctcaaaattttgttgctgactacttacggcctttaggatttgatattgatcaatgggcattatatgacaacgatgacattgtggttggaaccaaaaacggtgattcgacatatcagagcttgattattaatggacatattgacgttgcctcgttaaaccctgatgagcaatggtctttttcaccttttgagactgttattcaggatgatcgattaattggtcgtggtttatcagatatgaagggtggactagcagcggcattgttcgccttaaaaactttacatgaccaaaacatttctttaccagggaaagtattatttgaatccgttattggtgaggaagttggtgaagctggcacaaaatcaaccattgatcatggttatacagcagactttgcactcgtaacagactcaagtgacttagaggttcaagggcaaggcggtgttatcacgggatggataacaattaaaagtgatcaaacgtatcacgatggcttacgtcgtaaaatgattcatgctggtggtggtttgcgagcagcaagcgctattgagaagatggccaagataattattggtttacaagagctagaacgtgactgggcaataaataaggtgtacccagggtttcctgctggtacaaatacgattaatccagcagtgattgagggtggacgacatgcagccttcgtagcagatgaagcgcgtttatggataacagtccatttttatcccaatgaaacctatcaatctgtcactaaagaaattgaatcctttgtaactcgtttagcgcaagccgatccatggttacaaaatcacttacctatttttgaatggggtgggacttctatgattgaagatcgaggtgaaattttcccagcactagaaatagatgaaaaccacgctgcagttcaatcactattaaagtcacaccagattacatttggaactaggactaacatctctttttcgaccagtgtcactgatggtggctggtttggtgatgcgcacattccggctgccatttatggtccgggtgatttaaataatgcgcatgctgttgatgaaagcatttcaattgagcgtttggtgtggtacagtcaatctttagcacattttattgcggagtggacacatactaaaaaggagtaataatggtatttagtcaagaaattcttacagaacttagcgatgtttggcaagctaatttaaaacatccatttgttcaagaaattggtgagggtactttacccgtggagaaatttaaatattatatgatacaagattatgtttatcttattcattatgccaagatatttgctctaggtgcgcttaaaagtacagacctagagagcatgacgcaattttcaacgattcttcattcaaccttaacggatgaaatggcgcttcatcggcaatatgctgcccaatttaacattagtgaggaaactttggcatcagcacagccagccccaacaactttggcgtatacaaattatttattgtcagtttctcaaactggcggacaagcagaactcttggcagcattgttgccttgtatgtggggctatgaagcaattggcaaaagcttatctcactcgccaggttccaaacacgtactttatagtcaatggatcgagatgtatagctcacctgaatttagcgcactgactaaatggctaattcaaaagtttgatagtatgacagcgaaacaaactgttgaacaacgaacacacttaacgagtatttttaaaaacgctctgcgatatgaagtgcttttttgggaaatggcttatcaagaagaaaaatggcttgtgcagtaaacaaaaacagataaaaagcacagctttggtgggctgtgctttttataattcgatcctttatttattaaaagccacttacagggtctaaatatcaacaatcattatgttctgctgaatctaatgatttgcgtacatggaacaaaacctggtgtcaataaaataaagtgatcactgtgaatcatgtaagagagacgattaaaataataagaactaatgtaataagtaatcttacaatatgatgtttgaaatgaaacgacttgttttgcaaaccgttgagaatagcagttaattggaaaataattagcccaataatagtcactattttaaacgatcccaaacctatgaaatttgaatataacatagccagtccgctggtaatattcaatacattcccccaaaaatttttcgatctcaatccttttactgatgcagtcatcattagcagcgcatatgttgaaattactatttttaaaatgacaataaaaatcattatttgtttctcttttccttttgatttaaaaacgaattaatatagcatattaaagagacttttacagcccagttttaaaataacttgtcccttggtctcgataaatatgttggtatacttaaaagttgcctgttaaaagtaatacaaaaaagccaacgatgactaaaaaaataagtaataacgtacctttgatgcttatgaatgcaaatctttgttcaggatgaaatgtagactcaattaaatgagagtcttgttcaaaattttctttattcattaaaaatgctcctatagaattgatatattagtctaattttagttggtcatctagtttactctataacctgtatcagttacaatgatcgcttcatgattattaattagtattaaattaagtttttttcgataggcgttataagtttcttgtactgtttttgtaaagggacgttcaatatagtgtggcaaagtataaaaatcagtaattcctaaaccactataatcaatcaaatatgaagccactttgggactatccataattttgttatattcaataccaggggctaaactaatagctcctggtgattcaccaatgtagagcgtaccgtttttaattttttcagtaagcaaaggtaataaatttttatgttttaatttctgcaaaagataaaacgtgttcccaccggttataaaaagtatttcagcttgttcaattttatggacaacggtgtccgtatcttcattaggcacatatcgatattgcttattataacatttttcaaaacgctgtattttgattatcaacctcgatgcattggcagcatttactttgaagtccataaaatgctgaacaagaaaagaatctaacaaacactaaatcaataattgatgttgtaatacttttacgttgaggtgctttttttataaaatatagtaaaatatatattattataaataatagtgaaaaaggatgttcgaaatgacaaatgaaatatatttttctaatgaaaaggcgattactgcggaagaactatctcgtatttttttagcgtcgggcattcaacatcgacccgtcagtgatttaaaacgtttaaatacgatgttggagaactctaacatgctttggacagcgtgggatgactcaaaattaattggggtagctagagcattgactgactacagttatgcttgttatctatctgatttagctgtagatgcatcctatcagaaacaagggattggacacacattaattcagaaagttcgtgaagaaataggaccagatgtttcgttactacttctatctgcgccctctgcaatagcgtattatcaaaaaaatcaatttgagcatgttaataatgcgtttttaattaaacgcagacccttttagatttattaatcaagttaacattttattataaataagaataacaaaaagtaacatttgtattaagtaaaatatgcttaagtccagatcaactagagcattagatatatatcctcagacttggagcagcgactagaaaaattacaaaagactattgtaattaaatatttttatctgtacaatcactgaaacaagtaattatacagataagtaaagaaggaaatgaaatatggttgaggtttatgttgcaagtgcttttagcaaagatagctctggtggtaacaaagctggaatagtttttgataggcccgatttgatttcagttcaaaaaatggcaattgccaaagaattagggtatgctgaaacagctttcataacaaaatcaagtttggctgactttcgtttagaatattttacgcctactgaagaagtgccactttgtgggcacgctacaataggtacgtttgcaatcttaaacttacttaataaattaactaaaagtgagtatacgatagaaacaaaatcaggtttgttatcaataaatattgacccagatgggatggtattcatggaacaaaagacgccaatattctttaatgaaatagcatcggatgaatttattggctgtttagatactgattcaattcttgatacgctaccaactcaaattgtttctacaggtttaagagatattttactaccaatgaaatcaactgtagacctagaaaaattaaatcccaatttcgccattatgacagaattgagtaaacaacaggacgttattggtgtccatgcgtttgcactaacgggaagaaagagcagtatcacggcagtttgtagaaacttcgcgcctctatacgatattgatgaagaggccgcaacagggacttccaactgcgcattggcttgctacttatttaaatatgttgaaaaaaaatcacaatatatttttgaacaagggtatcatttgaatagcccatcacgcatagttgttaatttaaaaagtcatgatgacatcatcgattccgtatttgttggtggttatgggtatttagttgaaaaaaaatctgtgtcagtataatcttatacaatttcaggaatataaattaaaagcattgataagcactgtcaatcaatcccagaaacccaatcggactaggattaactattgtattcacagttatattgattattgtgtttattcaggtactaaggtaatttgctatttatagaaggaatgaaaaaggcaagcgattgtctttttttgacccattgatttgattaaaaatggagtgattttatcatgttatcgtcaaattttaacatagcctggtttggaataaagctaaaaacgaacacaaataatcgatagattaacaaacttagggagggtgtagtcaagaaactaattcgaactatgttgaacatgttataaagtgaatttcaaccagtgtttcgtggcaattaaacttacaagtcattgctaaagttattgtaagtttagaagaagcaactatataaccattgggaaaaaccgttcaataaaaatgaaaaattttgttatagttgaatgtagtatttaaattgtaagttaacaatgtttatgtaatatagattatatttggacgttttaaataaggagcatacatgacaaacggatacgaacaaccctacaaagtttttaaaactgtttttggagaaattaagtacaacgtggtaggttctggagaaccactcatactagtgcacggtaccccttggtcatcatttaattggcgtaaattaattcctgccttgagccaatggttcaccgtgtattattacgatttgttaggttatggtgaatctgaaaaaaatgtaggtgacgtatctctgggtgtacaaaatgaaattttatctttgttagtaaagcactggaagcttactaatcctaaaattgtggggcatgatttcggcggatctacagttctacgaacatacctgctgaataaaatagaatttgatcaaatattattgattgatccagttgctgtatcaccttggggatcaccgtttttttctcatgttgctttgaatgagtcggctttcaatggcttacctaactatattcacgaagctgtacttgaaaaatatgttactggtgctacttatagcgaaatggatgtagaaactttaaaaggaattaaaaaaccttggttgaatgatgaagggaaaaaggccttttaccagcaaatagctcaatcaagtcaaaaatatacggatgaagttgaaatattgtactccaatataaaaaagccaattattttgttatggggagaagaagataattggatacccataaagcaaggcaaaaaacttaataaaatgataccaagttcttccttaattccaattgggaatgcgggacatttagtacaggaagatcaaccagctttggttttgtcttatattcttaagtattttaaaaattgactcaatattatttattttcaaagtaacggactaaatgctcgcaaagtcagattaactaatcgatgcgctatactttgttttagtttgtcttgtgtaactagactagaaacggagcaagtttgtttaaaatcagcaatcatgtcatttagtgtggatttatctgtcaaaaccacgccattttcgaaatggtgtacgaggctacgataatctaaattaacagtaccgataatagcgacattgtcatctgaaatgtaatattttgaatgaataaatcctggcgtatattcataaattttgatgcctgagctcatcagccgattataatttgcgcgtgtcatcgcgtaaattatttttttatctggaatacctggagtgatgatgttaacatctactcctcgtaacgctgctgactgaaaagcattggctaattcaacatctataattaaatagggactagttattaaaacgcgacgctgtgatgttgacagtaattgaattaacgcaagcttagagacacgataattatagattggacttggtccatcgccaaaaggtaaaacaaaaccttcagattcaactggttttgctaataaatattgctcaatattaagcgtacttgacatattattagtgtaccagtcgacaaaaaacattttagtcaactcattagtagccgatccatctagacggatagctgtatccttccagtgtccaaaacgatcgataagattgacatattcgtcagcaatattaataccacctgtatagctaatttgaccatcaataatcaacattttacgatgagatcgattattaacatcactatttgcatcaccagtaaaacgtgcaaaaggtgttatctcgatgccgcgttgatccatcaaggttttaaaatcactcggtaatgtcttaaaactgccaatatcatcatacatcactctaacttcgatgccttctgctgcttttttagttaaaatatctaaaatgctatcccaaaattgtcctgtctctatgataaaataattaacaaaaataaatttttcagctgtctctaaatcaattagtagctgtgcccacattttttctccgagcgggaagtaggttaatttggtattttgatacacttgatttccagaggttttttcaattaacttgactaatgattgtactttaaactcagtaggctgccgtagtgttttgccttcagtatgttgcagcaactgttcgttagcttcgtccattcgttttgtgtattttttagaaagttttcgtttaccaaaaataaaatatatcatcattcccgaaatggggactaaaatgactaacagcagccacgggattttaaattcaggattttggtcagaacttataattattgcgacaacgataaactctgatattataattgcaacactaaaatacggcacatatttagttaataaaacaacaataagcaaaatcataaaagtctcaaagatgagtttcataagtgaaaaaataaatctatgtggtaggttgttttttagcataagaaaataacttatctccaatttttattatggttaatccgacgataatccgttctgttaagagtagttaaacattttaaatagttgcatttataattttattgttgtctattatctaagtttgactactattatattttattaattatagcatggtatacaaatggtttagttgatcattctttaaacgaggcatttatttaaaagcactagtaaagggtgtagtgcttttttgtaatttggtttttttaatctagtactacgatagatttcaagaacacttatcaatattgaaaaacagtctactagcattagcaacgaactatgtcaaaaacaattgaagttcatgattgtttgtcaaaaagaacaaattaaaaagggtatcgtgtgatatcttgtatcgaaactattgacacaatatatagtaatagtttatattatatgtacacttataaaaaggaaaagaaaaaatgaaatatagttttgagcagaaagcaaacacttcggttacaaatttatgggcattatatgctgacgtcaacaaatggtttacttgggaaaatgatttagaagagatttctttagatggtttgtttgaaactaatactaaaggcagcatgaaattagtcaatatgccaacaatggtatttgaactagttaaagttattcctgaagaaacttttattgataaaacgactatttcgaatgtaggggaaatctatttcattcacgaattgcgtgctaccaatgctaatgaaacatcaataacgcactctgttgaattcataccttcaaacagaaaacccgaaattaatgatttacaattcgtttcaaaaatatttgaagatgttccagcaagtatttttgcacttattaaggctgctaccaatgactcaaaaatttaattccgaatttaaagacaacgcggttgattccgtaggcctctcatttataaaagtttataacttatggcacacacgtataaaaaatgaattacgtaaatacaatttaactcacccgcaatttattgttttgtcaacactagcttatttgacgcaatacaatgatgaagttaatcaagtgaatattgcaaaacattctgatattgatgttatgacggtttcagtaattataaaaaatttagaaaaatttagttttgttacacgtaaagcttcaaaaaaagacaccagatcaaaagttataaaacttactccaaaggggttggatattgtcaatgaaactttaccgataattgagaaagtagatcaaagtttcttttctgttctaaaaacagagaaaagtcaatttaataatatgttacaattactaataaccactaattcaatcacggataagtaataaagtattatttattaaccaagaataaaaaacacggtttaatatgactagtgttttttttaatattaatttgtagccatcgagagaattttcaaggttgctttaactattaataaattatgatgtataaagtagtaagttggcacaaatcaaattgtgctgacttttttatttatatttaaattttgaaaggataaacaatgacacaaaaaatatggttaaaaccagaccaactagaaaactatatcgctcaactacaaggatttaggaacacttatcaatcattattgaccgttctagcatctgatcgtcagaattttgagtttaaacctggcgcaccaaacttccaaaatacactccagatgtcaatgaagttacatcgttacattccatcaggacatcacaaaccttttgcgatgtcctgattttcggtaaagaactagataaacaagtacaaactttaattgaaaccagtattgctttaacctttgaataccgtgacttgaccaacttattaaatggtcatgatgttaatagtgaaaatggtataaatctggttgaatctaaactaaaacaagcgaaaaaacaattttatgaatcctcacgataggtcatattaggctattaatttttaaaacgtttatcatcttgatgttataaacgtttgttagtctgaaattgtagtttactgatcaaaggagaataaaaaattaaataacagcagaagaaccaaagaaaaggagacgacaacctcgattaaacgaaaatcagcgctacttaatcgaacatttgtggaataatgaacaactctcacaaactgatattggtcgtcaattagggtatgatccgtcagtgattagtcgtgaattagaccgtggcaatgtcctggatttctctaatctagaccgtcacactttattaagaatgagcattcatgcacggattaagtattcggcgcaacgtggtcaatacattgtgactaaaaagcgctttcgcatgggacaagggctattacttactccggaattaaaggaactaattgagcactggattaatgtagaatattggaggccagaacagattgccggcaacgtgcaagatgtggaagtatcgtcctcaacgattcgagattggtcaaaaagaggactaattaatattcgtacccataaatatcaccgacaagatggttctcccaaacaacgtgagttagctaaaaaccaacgggcacgccaacgagagattgctcgcttacgagaaaacttacaaaaaagtggtgagttggtacgtcattccatctatgatcgttcaccagttgtggctaaacgtaaacaatttggtcattgggaaattgatttagtgttaccaatgaaacaaaacaacggtcaatatcaagaccactccgctattatgacagtcgttgaacgaaagactagattctacgccttgattaaagttaaaagtaaacaatcgaaagatatgattgaagcgtttaaactattttatgaacgttatggcaaagtggtaagaacgattacggctgacaacgggtctgaatttatctcttgggattttttagaatacgttcaaaaagagcttaaaattaagctctattactgcacaccatcatcaccacatcaacgaggttctaacgaaaaccgcaacggtaaactgcgtgattggtttcccaaaggaaccagttttaagccagtgaagcaacgacaactagatgaagtggctgataaaatgaatgccatgccaatgcgaatagcattacaaggtaagagtccaattgagttgtttgataaggaatataaaacaatgcaaaggtatcgtcgtgcgtatgagaaaagaaaattaaaacaaagcaaacaaaactaattctcagcagtatgcaataaataatgtttcaagcttgacttttttaaatggtaatatataatttacttaagtaatatatacattacttaaaaaggatatttgtgatgcttacaaacaatgtcaaaaaatttagagttgaagctgaaatatctcaaagggatctgtcttatattgctggcgttactcgtcaaacaatgagcttaattgagaaaggtgagtataatccaacaatcagcctgtgtttgagaatttgttatggactgaataagacgcttgatgaagttttttggttaaaacagggggattttgaaaatgaaaaaagtcgttgatgaacgtttaaagatacaattaatcaaaaattttaaaatagcctttctcgttgaaaatgccgttattatattaatgttaatttatcaaagctttaaaaatatggacaaagcaattagtgccagtaatccgatctggactgcgttaatcgtcggtacaatgacgctatcatttctatcagttaatgtcactgcaagcattgaagataagccaaaaaggtcaaacttaaaactattgtcttatttcatgcttatatttattattggtagcttattttttatggttatattgccaaagcatattttactggcttttctttgcgggacagtaatcgctgtatttgtatcaggtcttttaatttatgaaaaccactaccgataccgagataattaaatactgccaattgcttttcaagtcgatacactataatattgttatctgttcgataatatggtaaattcaatgaattacacgtcttaattttttggaggtattatgactgatcaaacgcaaataatcattatggttatttttctcatgatttatattacaggtgtgactatctatacaaagttacactataaacaaagcatacgtaaaactggcgttgatgtttcaactaaatcaccaaaagagttacgtaatttgttcctcaagtagttcctaatcaacttaattttgctaattatttgttgtttaccaatctaatcatctaattaaaacactataaaaataccttaaacaactagcaattgtttaaaggtttttttatttaactattttttcttgctaaacagaacaattgttcgtataatgaaattacggttttgttgggaaaagattaatgattaattaaattacacgataaataatttattaattttttgttagacttagataaagaggaaaatttaatgaacgcaattatttttcatggatcagcaccacatgctacggtagacaaattctggtatcaaaatatcgctcagagtttaactgatagtgggattactgcagttgttgttgatttaccaaaacttgatcaagaatccttaacagaaacattaattagaattaatgaaatgaatttagtaattgatgaaaacactattttgattggtcattcagctggaacaaatattatctttgctttgttggaaaacatcagcattcaagctaaatctgtctatctaattgctggttatagtcagccaaatggtatgcgacatacaacgttaaaaaattcttatgactggaataagattaagaacaattcaaaagaattctatatacttaattcgtttaatgatccttttaattgtgatgaaaaacaaggtaaaattttgtttgatcatttgggtggtactttaattttgcgtaatgatggccattttaccaaaaagaaccaaccattattgaagctattgttaaaacaatatacgtaatttttgtcataacggtttgtcaaaattacaattcaaacatttaaaagttgtaaattatgagttaagtcaataatgtgattaaatcaaaaaatacagatactcagcaaaacagattgcatattgggtatctgtatttttttagaaacttagttgcggaatcaagatgttaaacaaccttaaaataaggattagaaaccaatgtattttccgagttatttgttaataatgtaaataagtatagttcattattcaataatcaagaatattttgaaacatataatttagctttgattgaggacacactgccttcagaaactaaaaacaagttatttgtaattgaaatcgaatcaatactaagacaatttatcttgcttcaaaaagaaaataaaattgatgttaataatttaaaatacatgcaccaaccaagatatgacaatattcattcatttataaaaaataaatatttagaaattaatcagaatgttgtatttaaatattttcaaaatgacaataaaattttgaaaatatttaattcttttaattacgttgaagaaaaatttttatcaaaaacaacattaaacagcatattgaaagcaactacccatgttaccagatactcaaatttattttctacaagtgaatctaattatttaagttattgccttgataattctctatttagtgacgcactttccttaagaaacatatatttacatggtgcgtctaaacatttttcagatgaagatcatcgcataaattatcttcgaattttaaattgtatgttaattattattgctaatattaatgatgaattgatttataaaatagatactctagaaaagattgaaactaataattaaacaaagcgctctagtgtaattaaagtatcttgtaaaaacgcatcaagatgtttaattgagccatagaagtataattcaataattgtaaaagtaaaaatttatttaggaaaggagcatagatgcccagaattccaaaactcaaaatcaattttgagtacgaaaaaaaagaagaaagaaaaacctatcaaaattcctaaagtgcatactttgaacttaggtcgggttcgttcgattgtcctattaatattaataggttttttttatttactttagttatgtgctacttttagcaaatgaaactgcgcataagaataaaaccttacaacaaacagttgctactttgaatcaacgtattaaccaagaaaatgctggaacaaccagttataatccactagtggatcagtacatgacctagtttttaaaaatccactattcaccatcaaatggtgatttagataatccaacaataacacattgtgcgggaaaagattataccattcaatatagccagacaagccgaaaaacaaatattaaaaagtttcaccagtgatttggaaaattaaatcgtattactacatggttggttcgatactaagacccaaaaatttattcctatcaaaataaataccacgaactaatgtgtcatatatacttgacacacttgatggaatattttagactagtgttagtcacatataaatgacactggagttcagtatgaatcatatcaaagagtatcgcaaagcaaaaaaaatgtcacaatacgaattagcacaagcaattggggtagcgagacagaccattaatttgattgaaaatgataagtataatccatcattatcgctttgtttgaagttagctcatgtgcttgaaactgatctgaacacacttttctgggaggaatataatgaagactaaagaaacactagcaacaaaactactcaaacgcttttatggtgttcagggggtattagatgaatatcggcgtaatgaaatttataaaataggaaataccggctttatagctatgttttactatgccttatttagtaactttattgttttattggtttttagtctcgataaccatcggcatactgaagatatcttaatgtggtacattatagcgaacataatctttctaatatgtggtatttgtgggtatgtgctgattacaacacgtcgtcgtcatttgttagagaatgaagttcaagatattgaaactcaaaagaaacaccttaaatacttagccatacgtcaaggaattttctttggagtgttcaattatttatttaccgtactaatgtctccggaatttagtgatcttcggtctatacgttctttatttggagcaatttttgctggtacattctttggtgtagccatgtacttatttcaaagaatgaatttaaagaaagtatagtaaataatgattagacaaaaacatcttaagtttttcatgcttatatttttgggtggtgtgataggttatttaatgcaaatggctccgcatctaaaatatcaatggagtcaaaacataatcacctttatggctactgatttaggttcttgggcagttattactttgataatctgttcatattctgatagttggcaagagtcagctatgaatacggtggcttttatgtggagcatggttataacttattacgttttaaatccattaactgctacaggtaacttacactggattgttttagcaattttaatgttacccattggggcgataggatatttttacaaaactaaaataagtgtggcgctattatttatcatcggttgtctgtttgctcttacaatacagattatgacgattattaaaatggttacactaaaccaaatgattgtacaaaatcaagcgggcatattaatcattgttcatcaaacctggtttgcttacacaaatcgtatactacttgctttgataactatatctggtatgtttgcagtgataaactattggcgaattaagttgaggaagggtaaacagagtagagtaattaataattaaaaaaggaatgcatcataaaacaatgtcagctaactgctcgactaataaaaagcaaccccaaattacctttttttaaatcatttggatcaaaagatttccagtatacggaagtatacgaatttgctcgctatgcgtccactaaaaaattgtcctttatttatacattgagattgtttcaaaatatgttgtctcatataccagataatgctgttattgttgcatgtattgatagtgatttatatgacaaattttgtagattgggttttccttttgataaaataagtgagcctatattttatctagggtcactgacagttccagtaaatgctaaagtgaaaaatatagaagattggctcaataaacacaagagaatttgcagtcaatagtttgagttgcttataaatactcttatactaaaacaatgagtaatttttatttagtccgcttaattataggtgtatttttatatcaagtggttattcacaagaccttgaacctgacagaatataaatgatttatgaatcaacccattaaagcgctgttcgttcacttcaacatgcacctatggtttgcaaaaaaagggtcaagagacacgacctgaaatgttgaaacaagaaggaaaagaaaaaggccagccaattggtgtatgctgacacattgatagttcttgatgaaaagacactagacaagccagcatcaaatcaaagtaagaaagctactaaccaagctgacaaaaataaataacaaggcggtcttgcgactatacaaaggcagtttgcatttaatctaaacaagattataatgaaaataatttctgtggaggttatatatgtatagggtaagaagatttttaaatactgatgctgagttagttgctcaattaatagctaagacaatgaaaacaactaatataaaagactattcaatggaatacattgaaaacgatttaaagtcactacaagcgaatgatgtaattgaacgtgcagaacaatttcattgttatgttatcgaaaattctgataactaccaaattataggtgtcggttcgattggccccttttggggaagccagtctgaaagtagtctatttaatatttttgttgacccagattatcaaggtcacggtttgggcagaaaaataattgaaaccttggaaacagacgaatactttttaagagcctcacgtattgaaatacctgcatctaaaacggcgttacatttttatcagaaaatgggctacgattttaaaaatggtatagatgaagtcgattccgaagagttgtatcgtttagaaaaatttaaccctacttcaaaacgtcagaccaagtagctctgattaatataatgagaaagattaaaggctgattaaacaatcggtcttttttggttgttacaatggcacagaacttgatttattttagctttatagctggggtttggctcgtctatgttggattttttttccctacattgttgctctttatgagcttaagtcgctcactacatttagctatgataattgctagtgtgatgactattttatttattgttgtacagcaaacttttagggatttgcatttaatcaatcaattacaagagaacatttgaacaaaaatttttttaaacaatatacttacatgtgtaacgttaaacaagataatattgactacgccagcttactttggtacattatctttatttgataaataaggagataataatgaattggaaaaagtttgcttcaacaataggtggtatgtggttagcatacctagtatacaaagtaattacactaattcttttgtatacctttgatgggttacaatcaaagccgtattatgaattcatttattttattattgttgtttctattacattagtaattttcaattggacaaaacggtttttcaaacaggaaattatatttagcccgaatattgttgctttaaaaaaacaatggtcaatactgatagtccctctattcttgtatggcatcgatacatttgcaattctccccagtgcaacagaatattctttttatatcgttatggcttctattgctagtgcgttaggcgcagctatttttgaagaaatgcgagattgaggctttggtggtatcggattggcattatctattgaaaatagtcaatggaaaccgatgtttattgcaatcgtaacttcttttattttttcaataacacattattttaatttactaatgcctaatgcacctacacttgtagctacaaatcaacaggtagtttccacattcttcttgggcatgacctcgattgttttatatatgcgaactggaagcatattctatagtattttaattcattttttgaataattttactttctggacacctacatctgatttatctcaagatgatggttgggcatctatgttaattttttacgctcttattcctgggctatattccttgtggtgcttaagacccaaaaaatcagaaatgaatttaaaatatttacccgacaaacaatcagactaacttattgacaaacagtttctcaaaatatgtaagccatcgaatacgatgtcaagactgataggaattatcattttttgaacaaaacaaaagatagatactgtaaattaattaaaaaaatatttgagagaaaggataagagctgataaacagctcttttttatttaaaaattatggaaaattcaaaaaagtataaattataaaaatcgagtaagttgtgagttgtcggagccgttacagttgctggtgttactgtgagtgctaacatatgtaaatgctgatacagtttcaacgactgatgcacaagctgttaaaacaactgatgccacgcaaaacgacaagcaagttcaattaactgcttcatcaacttgtatagctacggacaaggcgacaactgatgatgccactaaatctgcaactgtttcttcaactgctgaaaaaagcacagtgccaacaactgctggttcaagtgtgacacaagaccaagcaaaagatgcggtcgataaagcacaagataccgttaagagtgatgcggacaccgcttcaaaagctggtgttgatgtgaccactggtaagacaactgatgtcataatcaatgatgacaacgcttcatcaaaaacaaatgaagtcttatctgatttgaataagcaaggtcaagcagatttggataatgccacatcagaccttgataaacaagttgatactagtgaaaaagctggtattaaagtcaacgttgaagtcgcacaatcttcacctgaatataaggacttgtctggactagagggtcaagatttgttagatgcaatggcttataacattaacttgtataagcaagcaatcgcagacggtatggcaagtgaaaaagctgatactgaaacattgtcaaagttaacggctgaataccaacaaaagcaatctgattatgctaaagctaacgctgaccatgatgaagcggttaaacaaggcgaaactgatttgaataatgcaacatcagaccttgataagccagttgaagcaagcaaaaatgctggacttgatgttagtgttgaagtttcaaaagtttcgccaaagtacaaagatttgactggcttagagggtcaagatttattagatgcaatggcttataaccttgatttgtacaacaaagcagtagctagtggtgttgctagtgaaaaggctgaccaagcaacactcgttaaattgacggctgaatatcaaaagcaagtagcggactatgaagcacaaaaggcagcggttgataaggcaaatgctgataaaaaagcagcctatgaaaaagcacttgaagattatatgaatgggactaaccatacgacaagtatgacagcccaaacgcaaactgatgcttcatctggtcaatatcaaacctttatgaatgccactgttgatcaaaaaacaggtgagtttacgctggaacacgatatgaacgacggtgtacacatcattggtcatggtgttttgaaaggtaaagtcaattggaagattgtttcaaatggtgacggcacagaaaccgtgacgatttcatcaattgaattgtattcatatatgtataccaatgcttatcaaaaccaagcggttaaccaaaatatcaatttccacgtctatgacaatgacggcaacgaactattttcggtttaccatgacggcaatacgacattctcaaagacaatcaataagactgctcaaattaacaagactttcaaaatttcaccaaatgagactagtccattgacacaggtattggttgttgatgataactggatttggaataaacacggtcaagtatcaacgcaaattaagaatactaacgtagcgccaaaggcaccaacttatgagcaagaccctgtgaagcctacggcaccaaaagcaacagtacatcatgtacaagttgtcgcacctgctaaaggtcaagagcctgctgtaccagttgctagtgttaaaaaggtaacggtttcggatatgccaaatgctgataagccacaaccacaaaaggttgcagtgcattattacaacattaagaaaacaccaaaggttgaaaagacagctacacccgaaacgccaaaggcagttgaaacggcaagtattttgccaacaacgcatgctaatgaaaatcagggtggcgttttgttaagtgcattggcagggttagctagtcttggtttggcttttggtatctcaaaaaaaggtaaaaagcaaaactaataaaaacaactgatctcgtgacgttatcacagaatataaccaaatggggtgtgaagcccaattgtaaaggagactgttatgtcagttattgaaaatcgagaagtgaagaaacgtctcaattatttacagtcacaattagacttagtggactctgcttgttggcacgctaccaattttagtcgctagcgttgaaaatgagcgtacgatggcgcaatttgatgaagcaatgagtcaatttaagactgatttacagaaattgtatcgtgacttgtcagtgtttaatgatattaaattttaagaaatggaagtataagaaatgcagaaacaacttttaatcgcaggttcagtgcttggtgctttagcattaggtcatcaagcagtcaacgctgatacggtaccaaccacaactgatactagtacagcacaatcagtacaagcaactgctaaggtgttgccacaagttaagaatggcatcttagcattggcaatgtctggtttagttgctttgggtggtttgatttacaagcgtaagcatttgtgattcttaatcagttgtgacggatatgttataatactaggatattaatattatattgattttttcaataccttaaaaattggaggagtaataaaaatgccttacgttatttttattgcattagaggctgtagtcaaataagggtgttcatttaaagaataaataaactaagaggttaaaaaatggacacccgaaaaaaatctaaactatccgtagcattactttgcttattaattggttttccgcaaataagcgagtcaatatttacaccaatattgcccacactaagcaaagcattgaaagttactgattctaatattcaattgaccgtaagtatttattttattggattcgctctaggcgtattgatttggggtatactatctgataaatacggcagaaagccaatcatgctaatgggaattttgatatacctattaggcaatatctccttactgtattctaatagcttttacttaattatgatgagtcgttttattcaagcttttggcgctagtgtaggatctgttatcacacaagcaatcatgcgtgaaagttactcaggttcaaaagctaccaaaatttttgcgactgtcggcgcagttatctctattgcaccggctattgggccgattattggcgcgcaactagtcactcattttcattacatgagcgtatttttatttctaatagtattggccataatattattgatactcacttccgttaagctacctgaaactaacttgatgaaagttgattattcgcttaaagcattaataaccgttgcgttcaggttactaaaagacaaattcgttctattgaatgcttttgccattgcagttttcaatgcaatattgtttaacttctattctgaagcaccatttatttttattaataatttaaaacttagtaccagtgcttacggcaatacaggtattttaattgctctaggaacgattacaggtgcttatgttgtcaataaatcagccgtgaaaactaacagttttaatgttattcgattaggaatctgtattgctgttgcctgctcaattttttcaatttgggctttttctagtgccaatattttgatgatttacattgcaatctttggtatattcttaggcatcaatattgcactacctgttattctaaaaacctctttaaatgcttatgaagaagttatcggtattgctagtgggatttttggtcttatgtattattgtatgattggcattttgactttcatcatgagtatcattcatactggaaacattctagtttttccaatatatactttggcattggcaattggcttatctattctgattttcgtcaataaaagtagttataaaaatgtctgattaattattaaacttcaagaatcaatcatattttatgattgatttttattttgctaaaaattattgaaaggggggtgtgaaatgcgtggtctcccaaaactcaaagtgaatttttagtatgaaaaaaacaaaaggaaaaagcagtaaaaatacctaaagctcatacaatgaatttaggtaaggtacgtaagatagttctcctattttcaataggactttttatttactttagttatgtattggtacttgctaatgcgatcgctcaaaagaataaaacgttgcgtgcaacggtcacaactttaagcaaaaaattggataaagcaagtgctggtacaacaagttacaaccctgttgtcggtcaatatcttgccaactttttgacactttattatgcttcatcagatagtaacgctgacagtcgttcgttcccaacaattaagcaaatatttggcaaataatatcacactacctaacaacgtgggtaattccaaaaggaagttagatagtgctaaattaaatggcatattcactatgtcaacgtaccgtatgcaccagaaaatgaaaaactaaccgtgattggtttgccttatgttgcgaacacgattgatagtgttggacacattggcagtgctatattttcaaaaactggtaagacaataaacaataatgaagtcacgacaaaagtcgttaagtttaccaaacaatttgcacaaaatatgtatcatcttcaactaaatatatgtcaatgttaatgtccgaccctgtggggttaaatggtgcagttgaccttgtgacgttagatgatagtagtatcaaagtaactggtatgagtgaaaaaccagttgtgacagcgacaatgacagttcaagttcatggtacaaacattttgcaagtacagacaattaggttagatctgaagaaacaatcatcaacctatttcgtgactaaatttgtacaagcatagaaaggagtattatggatatttataacgctttgaaacctgtgttgctttttggtgttgttgttatcgctggtggtcgggcaatcggacattatggtaagaacgaaacaaaagatatgtgggttacaatcttaattgatggtgttttggcaatcacaacattgatcaatgccttgattatttttgtgttcaaactttatactgtgaataatagtactttaacatggggttttgctttattggttggcacactagttggcgtttaccaattaaacaaagtattcaaagttgatgatttaccatttgagacaactgttaaatatgccttaacgcattaatttcgcagcaacttgccacgtccttgtgttttttgtagagactgtgttttacgcttgcgtcttacagactctttatcatgcgattgtgaaagcgccacagagcagacggaattgagtcttttgaaccctcaattaattttacaggtgtggtataaaccacgcctgtaaaattaatgactagcgggactggggtagacaatattcttttgaattttacctattgattgttgacaattaaatacttttagattaatatgtaacatgttaactaataaaggttaacatgttacatacttggaggaacttatggaaaagcaagaaatgaaaacattaatagaagatgcttatgcagatgtattaaataacctcaaggtagaaaaaatagaaagatactttgatacgcaatatctccaaacaacagatagcgtaaactcaacgttcaaccaattcaaacaacatatcgtggccctacaaaaggtaacacgaaaaatacaagtaaccgaatttcaagaagaaatgtttgatgtagaaaatcagaaaatatttcttcattatgtagttaacgttaccaaaattgatggaaaagtaggccatgttgaagtgtttgcggtatttacagtaaatgaaaataaaattgttagatgcgaagagctcacgcgggcgttggatgataaaactttaaatgacttaggtagtaaacaatgacgcaaaatttacagaatagtataattaaaaaattaattagattgtacagtgctcaagcacaagttcgaaataaaaaagaccatctcagtcagtcaaacgattttcaaagtcttaatgaggtgctctcattaagacaactagaagccttgtccttaatcaattccaacactcagtgtggtattacaaaattatcaagcatgctgtctattagtaaacctgctgtttcaaggcttatcaataaacttgaaatcaaccaattaattaccatcactttcggtcaagataaaaggcaaaaaatagttcagctaacttctcaaggaaaaatattggctgcacaacatgatcgcttacatagtcaagctgttaaagactatttagatattttagataattttgataataatgagttactagcgattgaaaaatttatagatgcactgaatcagaatgtaaagttatgattcagtgcttttttattaggttagccataaaagttagtagcatgagccacattgtccatttaataatcaagtgaattggtgcccgagtagtaataaccatgttgttgttattactactttgatcatgctagaatgatggcattctagcatggtaccaaatattaggaatgaaatcttactagcagtactcagaacaccaatttaaatagtgtataattttaaatagctgcttttatttttcttgacatctcaatataaactcgttcgtcttttagtgtaccgtgcataatctaacgtaacagaggcttgttgacacgttggcgcacaagggattacacaatttactaaaaatccaaagtcaataatttgaaatagagtaacgtttttgtaacattcgttattttaaaagctcataagtcctgtgtgggcttattttttttgcttaaaaacagcctaaatattaagaaactgttaagaaaccgtcttcatgacggttaattattggtaataaaatcaatggaaattgacaactaaaacaagggagaaagagacaaaatgaaacattcttttggatcaattgtaaaagcctttcgggaccgaaaaagactaacacaattggaattagctgtgaaatcaaaaggggaattatcaacggctacaatttcaaaagctgaaacggatccaagttacaatccaaagctaactacattcatcaagttttacaaaattatggatgtaccgtttgaagagattgttgcgacattagaggggaatgctgatgacaaatgaccaagacacgcacaggaaaatggaacgagttagccgagatcaagttgaaactaacgaacgattctataagattccaaaagcattatttgaaaatgaattttatgctgaaatgaaactcgaaacaaaaatggcttatgccattctacgtgatcgttttctgttatcaattaaaaataattggattgataaaaatggtgatgtctacttaatttacaagaatagtgacctgcaaacaatacttagtgtcggtgagaaaaaagtcattagtttaaaaaaggaactagcaatttttggcctacttgaggaagaacgtcaaggcctaaataaaccaaacagattgtacgttggcaacataaatgctgatattgaagttattcacaggactaatccattgggggacaaggaactgtcaaaacggcagttccggaactgtcaaaatgacaggtcaagaaccgctaaaacaacaggtcaagaactgtcgaaaagacagtcaagtgagactgagagtagtgagactaatttaagtgaaactaaaaccccttatttggatgaggacgaaataaataataatcattgttcaaataattttcaacactcgtttatcgcaatcggaaaaataatcgaaaaaaatcctgggttacgaaatgttgttcaatctttgattccagacttactgctgaatgaaccaaaacaggcagaaattgttgtcaatgcacttgattgtgggtataaatatttggcggctgaacttgaaaaaggtaattctgttctgactttacaaaggcaattacaaggtgacgtcagcaatgtattatttctatcagaaattggttctaagcaattggaatatatgagcgaccatttgattgatattaaccagtatggcaattacttcgcaagtggcctggaaaatcgtttgagaattgctgtcacaacaagccaatcggcatcaggcttttaactttaaatttgagagaggagagaaaaaatggcaaaccaatacaacatatttattgcagtagatttcttcaatgcagatatactttttgtggctaattcatcaggtgaactcagccgaaaagttatcaaagcaattgaaaatcatgaattagaaagtgatggcgcagtgaggttataccgtacctcttatcaatcatttaaagcaattcaaacactgatgacacgctatcatttaccgttccatgaagccgcaagaccgaaagggagagattatgaaagtcagacaattaacgctgttggatgagcaaagtttacacgaactgcaacaaaccaaatatgtcgtcattctcgttaaggaattaaaagacaatctcgttcaaccaaccaaaaaacaagcctttgtttgcttaaaaccaagtgagatgaaagtcaaaggtgagctgtttgatgattgtctaggaaatcattacatcggctgtacagtcctaaagggcattcattattctgaatctggtgaccaaattcctgtgtttaaactaccaaataatattcaagattatttagtcaaccaattgacaccaattattactttactagatcaaaggaggagaaattattatgcaaattaatcaccacataggacgtttagttcgtgacgtaaactttaacgtaaggggcgaaaatgaaactaaaattgcctatttcaaattagccatcaacgatcttaaagatggcaaagccacttacattgattatgttgcttttaacaaaacggcagaattaattcgagattatgtgactgatgttggtcaagtagtggaggttgaatttgtgatgcgcaatcacaattacaccgataaaaatactggtcaaaaaatatacgccatgcaaaatcaagtgacacaattccgcatctataaatcaaatccgtcatcaaagaagcctgatgttcaaacacaggttaccgacactcagaagactgacatagctgatacggatttaccaccataccctgactttagtagtaacgcatttgaatatgtagaggggtaagacaatgacagcaataatcacaatagctgataaacttagaaatatctttcaaagatttagtcgctttggtacatggtttttggaacatcaacgacgtaatttgattggcatatttagcctatttattctgatagctttcgggacaactgtgatggttaacattacacctcgcccttcaaatttgccaagtacggagttaaatacaccagtttcatttggtactttgaacaaaactgctagcctgacaaaaagtgtttttaataaaaataatggtgttttggaactgcattatacaatctctgacggtgctgtttctgaccaggatttggttgatataagcaaaattaaaattactgctatgactgatcatggtggtaatcaggtcacaggtcgtgtcgtgccaacttcaaataatacgctcgtagtgcaattcaaaaacttgagtcacagcttcaatgctgtaacgctaacggctcatgataagagcatcaacacggcaacagttgaagcaccaagcagcgttagtgctgaaagttcaagtacgaagaaaacatccgcaaacatcaatacagcaagcggtaaattcatcatcaaccgtgacaaagtatctaaatcaaatacgctaacatttaccactcaaaaggaactcgaaattagcgaaagtgaggctaagatttcagcacaacaaaaactgatttcaaagaatacgaacgcaattgttgaatatcaaaaagcaattgatcaacaacaatcttccatcaaaaaataccaaaaaatactcgcccggtctgacgactcagacacacaaactagcattgataatgcgcgtgatgctatcacacaaatacgaacacaaattagtgatgcacaaaaaaatattcaacatgccaagacaaatattagtcaatatgaaaagactaaaaagcaagttcaagaaggcgaatcattgttaccaaaaccaaccgatttgtaattctaaatagttcagaaattccctattgggctatttttttgaattaattaaaggtttaaaaaggtttaaacgagggtttaaaaggggtttaactgtagaaaatgcttaccgccattggaatgcccgcacggcggggctgaggtacagcgtaccgccattcccccttaacctgttcccagttatcaaaatatatttaggagttttcatggatacagttagaaaagatatacgtggattgaatccagacgtattagacgcaatcgaaaaacgtgccaaacaagagggcgttacatcaaatgacttgttgagagaattgataactaactatgcgcgccagattgaagaagatagcgcagcaaaaatattgcatacttatctcgatgatttaatcatggctaacaataatgttgtgcacggattaaatgacaatacaattgcgattggtgaaatgtttaaaacaattctagcgcgtcttgaaatgtattttccagacttaaatgatgaggtagaacggattcaaaaaaacgctcgccctcaggaaaaaaatttgccaaagtcaatcgactttgatgagtttgaataagcagaggagtttcaaatgaaaaattataaacgtggtcgatttgcgagaagaattttattggtcattgtcatattgataggtcttgtgtatttaaaccgtgtgtcgattctgcaaaaatttgtatccattggttcgcagtcacagattattaatattgataaacaaagcagctcacaaacacaaaatgatgagctagttaacctgaaatatactggtcaaacagttgtagaggtcaaccataatcaaccaacatttacacaagatgatttacaaataaaagagggtggctggcaaaaattgtcatcactagattggctaggtagacctcaggttgctaacgccttattaaatcaaaaattgatgccaccctctcaaaagtataaagcgcgtgagcggttaacaataaaagcaccaggttaccatgccattaaaactgggacgaataatacagactggttatacaaccgaagtcatctgattgggtatcagtttactggactaaacaacgaagccaaaaatctgatcacgggaacacgacagttgaacgcagatagccgtgtcaatgctaaaagtatggtgacctacgaaacagaagtggccaactatttgcatcagtcagcaaacaattatgtgcgataccaggtgacaccaatttacaaaaatgttgagttagtgccccgtggtgttcacatgatggcacagtcaaatgacaatactttgaaatttaatatctatgtttttaatgttcaggatggctggacaatcagccacataaacggtaatgctgaaaggggcgaataaatgaaagatgcaatagaattcaaaacaagtcaaatgaaggcactcatcaaaagaagaaatgttttgaataaaaaatatgatacaacgctacccgaagatattcctttagaggttaaatcagaactaaagcttattgaaaatttgttaaatgaatttgacatcaatcaattaatttttgatgaaagaccaacaatgattggaattaaaaattcacgagatgaagaatggtattttcaacaaatgaagcattggatagaaagacacccaaatgctcttaatgcgaagtttagtcgaagtagtgtctataagtttgctttgcatttcttcgtagaaaatattgcacttaatgctaacaatgcacgtctcaattacttggaactagcccagaaggtaaatgatgccaactccgcaaaaagtgattcaaaattaactgcgcaattggcaaatgttgaaactttattaggttttcttctaaccatgcagcaacgccaacttgagtatattccagagggtatcaatttagaaaacggatttgtcaaatatgccatcaatccaataaatccgacagagtttcaacaatttggcgcgccaacagaactcaatccaaataatgagctagcacaatcttatgaagaatataaaaaaattcggagtcgtgataagcagcttatcaagaaatatcatcaaactggaggacaactcgatgacgactaaaaagcatagtaaaagaaaagcacaattgacaaagtatttagaacaacttgatgaattcaattggcaccatcctactcaagttagtgagatggctgacagtcaacatgaacgcgataatcgcacgtactatttggctcagataagtttaattctgtttaataactatcaacaatcttacatgcaaattgctcaaatgctgaacatgtcttccagaacagcccgccgtttgacagttgattatgaacaagattttgatagtttagaagaaattatggaggcattgcaaaatggcgaagactggtggaattgctgcatttgccctaggtgaaaaaaagacggcaatggtcaatttaccagcacaatttgtcacgtctagtacagcagatatgaagggacaaaaatacgcagatttagttgactatgctaataattcggagaagacaagtgaccttaataatgagtctataaccgatttaatcggcttaaaggaacaatttgacaagcgaggttatgcaaaccgaaattctgctgtaacagaaatgcatccaatttttggtaaggacaaattaaattatgatgatcacgatatttcattactcagaaaagacttggatgtggcacaagaaaatggtaataatatccatgaacttgctttttcaattcgaggggattggttagttaaaaataatctctatgacccagaaacacgtgtgattgaccaaaacaaattaaaacatgcagaacaggatgttgctaagacattaattaacaaaggatttaatttacctttgggagaagatgaaaatgatgttgtttggtttggtgtgattcatcaagatactgaccacctaaacatgcatctgtggtttgctaaaaaaagccaagaaacacggcctgagatgatcaagcaagaaggtaagtacaaagggcagccaataggtgttatacctttagaactgattgaacaagccaagcgacaattcagaaaccagttaatgtcatcacgggaactaaggcggcatcaggaaatattaaaaggtgttggtggctttaaaaaagaaattgttgagacagcatccgaaaacctattaattaaccgtcatgccaaagccatcaagcaaatttatgatgctttacctcaagacatgaaagggcggtggcaggttggtaacgctcatttaacagatggaaaaggcaggatggcaaaagcaaatcaattaaccgatcaactaatagatgatttgtttgccgaagagcttaaacctgaatatgagggttttaagttgctggcacaagactacgacgccattaatattgaagaccagggcgtgatgcataaggggcaacgcaagtggtctgagaataaggaagaggaattaaggaaacgcttagcgaatcaactgtataagcatttagcaaaaattgaagacacctcaataaatgatattgaccaacaaatgtctgaattgctgagtcatgttaaaaaacgtgataaaggcggtaacgtagatagaactaaaattgcatctagccctcaggaaaaaaaatcggtacccacgtcattggtcaacaatgtaaacccaaatacaacaaaacatataggtgatcagatgccattgcggggtggttcattcaataaaattagtcgcttgtggtgtcaggacatccgtgctgacacaaacgcagaacgtcgattcttaacacaccaaaagatagttgaacagtataaggcagaagaagagttcacgacacaagaaaaaaatagattgtaaaaaggagattacataccgataaatttatttaccatcaaaaagaactgaatctacttttttgatcaggtcaaatagctattgttatcgaaaaaatcttgcttctataagggataattcgtaaaaggaattttttatcagtgtcgagtgttaaaaatcaaatacaaatattatcgattgtcaacttcttttggaaacgtttctctatagattaattcaggtgatttaagaactatttcagggcgtgttctatttggattgattattctctgatgtagtagatttaacgcttcgtctatcatatcatctatatcaattttaaaggaggtaagcgatggtgaggaaaatttggctacttcgatatcattaatacttatgaaagctgtagtataaggtacagaaattttttcttcattaaacgctctgagtactcctattgccagcgagtctgatccaatcaagaaagcctgtgggagttcattctcagaatacgtattaagaattgttttaccaattctataaccagaggaagttgaaaaatcagttcctataaatatgaattcttggttatatatcgatatttcttttgcatagctttcaaaatatcttcttcttaaatcatcaaactgaaaagcgttgtcgcctttgttccacaatttacctccaataaaaccaacttttgtaaaattgcgagatcgaaattcattcaacgcccttgtgatggcaaattccaagttaggctgtacagaagtaaaaacaccaggattaggatttgagtcaacaaacacacagataatttccttctttatgatctcatttaaagcatcttgattaaactttccaattaacaaaacacctctaacattttcagataattccatcacatttttataaaaaattatttttagtccactttttttggctgttgcttcaataatctgtctcattttaacataatagacgtcttcaagctcttcatcaggattaattgaaaatattaccgcgagattaatatctaagaattgattagatccaacggatatatagtcaagttgtcgtgcaaccgtttgcacggtctctcgagtactatcagtaactgaaaaagtttggtcattatttagtattctggagacagttgctgaagaatatccggtttttagggctatttccttaatagtagtcatttttcacctcttcattaattatgtagaaagtactgtttatataattcatcgtaaaacaaacggcaacatttgactaatgtaaatttagtaatgaaagtaaacatcatttactaaattttaccactattacctctgtaagcgcttccatttactatgataatgagttattatttagaagtcaattgatatagaattcagaaaggatacgcgttatgactgacacattacaaatttcaaagtttctacatgggggcgactataatcccgaacaatggattgataattcagaaatcattaatcgcgattttacattgtttaagcaagccaaaatcaacacgttcacaataggaattttttcttgggcaaaaattgaacccaaagaaggagtttacgattttgaatggttagataatatttttgatagggttgaacaacaaaacgggaatattattttagctactccaagtggcgccagacctagatggatgtctgaaaaatatccggaagttctacgaacgaatgaacaaggacaaaaacttttatttggggaacgtcacaatcattgtttatcatcgcctgtttaccgcgcaaagacgaagtcaatcaattaccagcttgcaaagagatatggtcatcgcaaaagtttaattctttggcatatttctaatgagttgggaggtgattgccactgtgaattgtgccaagaaaaatttcgtgagtggatgaaaaataaatataagacgattgataacttaaataggctatattggtcatcattttggagtcatcaatataataattgggatgacatacattcaccttcgacactgggtgatactacttctctaattctgaatttggactggaaacgttttgtgacggaccaaacaattgatgtctttgaaaatgaagtcaaaccattacgggaagtgactccaaatattcctgttacaacaaattttatggggggaaatcccccagaatcaagcatttttatggatttagattaccaaagattttctaaacatgtagatgtgattagttgggattcatatcctaattggtccaatgattatgaaactacggaaaccttagctatgaaaacggctctaatgaatgatgttatgagggggttgaagcacgattcttacctcataatggagagtactccttctcaggtcaattggcaccctttcaataaatcaaagcggccaggaatgcatgagatgggcagtctgcaacagatagcacatggagcaaactcagtactttattttcagttacaccaatcacggggatcttcagaaatgtttcacggcgctgttgtgacacatagtttgagcaatcgtacacgagttttcaaagatgtaagtttagtaggaaaagatctagaaaaattgcaaccgttactcaaatctaaatacacacaccccaaaattgcaattgtattcgactatgacaatgtatgggcattagatgatgcaagaaattattcggatcaaacaaagaaatattggcatactattcagagtcactatagtgttttttggcagaataatatacccgttgatattatctctgctcaagatgatttatcccattatacacttgtgatagatccaatgcatttcatgatggacatcgagtatatggaaaaaattgaaaaatatgtgagttcgggaggcaatcttgttggtacttatatgacaggcatggttgataaaaattatttagcatatttaggtgggtggccagaaagactgcaaagaatttatggtttgtcttatgttgaaactgacaccctttacccaaaacaaactaataccatcatatgggaagacaacgaatataaagtactcgactatgccgatgtttttgaacagaaaggcgctacctcactcgcttattatgaagatgatttttatgctcaaaccccagccttaacaaaaaataattttggttctggcactgctatgatggttgctggcagaacggaaaaagattttttaaataaattttacagtaaattaattgataaatactcacttcgtgattcacaaattcctgttgaaaatgctgatgcacatttaagtatacaagttcgacaggatgagagccaaaaatattatttcattacaaattataccgataataaacaaattgccttgtttaaggatagctatacggatatgttgtcagggaatagtttaaatggaagcactacattggaaccatatcaggttatagtagcaacaaaggactgatttaggagaaagaatatgaaagacataactaaacagaagttttctcgaaataagctagtagaaatgatttcttttgcacttggtaatctagggcactctgcattctatggtgcattaagcacttacttcatcgtttatgtcacgagtggtatgtttgatgggttaccgcaatcggtagcaaacaagttaattggtttaattacggctcttgtagtaattattcgtttggccgaagtagttattgatccgattcttggaaatattgtagataatacaaaaacgcgatggggaaaatttaaaccttggcaagtaattggcgcggttgttagttcagtgttattagttgtaatatttactggaatttttgggttggctcatattaattggattgcatttgcgatagttttcacagttttatttattttactagatattttttattcctttgcagatgttgcctattggggaatggtgccggctatatctgaagacagtaaagggagaggaatttttactgccttagggagttttactggttctattggttggaatggtcttacgatgattgttgttccggtcaccacatacttcacttttatcgcaactgggaaacatgaacaagggccttcggggtggtttggattttcaatagttgtttccattgtagccgttttatcagctttggcagtagcctttggaactaaagaaaaagataacttgattcgaaatgctgcaacaaaaaaaacaagcattaaagatgtattttcaggtattattcataatgaccaaattttatggattagcttagcatatctaatgtattcactagcgtatgttgtgaccaatggtgttttattttacttctttaagtttgtgctaggaaaaccaaacgaattttggattgctggtgctattgcaacagtaatagggttttctactgctccgttgtatcccattctaaataagtttatcaccaggaaagtgttatttagtattgggcaaatggcaatgatcctttcgtatctgctttttatcttcggaaaaacaaatatgatgatggttacaataggacttattttgtttaattttacttttgcgcaactggttgttgtcttatcactaactgactctattgaatacggacaattaaaaaatggtaatcgcaacgaagctgttgtcttggcggttcgacctatgttagacaagataactggtgctttttcaaacggaatcgtcggaacaattgcaattgcggcgggcatgactggatcagctaccgcaggagatattagtgtagcaaaaattaatacctttgaaatttatgccttttacacaccacttcttttttctattctagccttaattatattcttatggaaagttaaaattaccgagaaaaaacatgccgaaatcgttattgaactggagaaaactttatcaagtggtgctaaaaaagctaacacttctgaagtgaatgttgaacttgaagaaatatttgcacctgcctcaggacaaaaaaagctacttaatgaggttgatggcaacataattactggtattggttttgctattgatccagaagaaggtaatttatttgcaccatttgatggcaaagtcgactttactttttctacaaaacatgttttgggtgttgtatccaacaacggattaaaagcaattattcatgtaggaataggcactatcaatatgcgtggtgcggggtttgtgtcacattatgtggacggccaattattcaaaaagggagatcttttgatgagctttgataagaaattaattacgaaaaacggatatcaagatgacgttattatgtactttacccaaccagacaacattatagatgttcaacaaattgataatcgtgtcgtcaaacatggggagcagatagcaaaattaacattcaggggtgaaagataacttaaaggtgggccggaaagtatgaacttaaaaagagattggttggtattaatcactacaatcgcaataactagttttctttcattttcagtatcggcttcggatgttactgttaaaaaaattaataatttgaatggtaatactataaaaggtgtcgatatttcgtctgtaattagtgaagagaaaagtggtgtacattatttcaatgaagaaggaaaaaaagaaaatatttttcaaatattaaaatcaaatggtgttaattatatcagagtcagagtctggaataacccatatacagagtctggcaatgggtatggtggtggaaattcagatttagcgaaagcaattttaattggcaaacaggcaagtaaatatggaatgaagttgttggtggactttcattattccgacttttgggctgatccttctaaacagaaggcacctaaatcgtggcagaatttatcttatgatcagaaacaaaagtcagtatacgcttacactctggatagtttacaaaaaataaaacaggctggaatagatgtaggaatggtgcaaattgggaatgaaaccaataatggaattgcgggtactagcaaatggccagaaatggctggtatatttaattctgggtcagcagcggttcgtaaagtggataaaaatattttagtcgccgttcatttcacagatatacaaaaacaaggaaacgataaatggatttcaaaacagttgcatgattataacgtagactatgatgttttcgctacttcatactatccttattggcatggtagcttaagtaatctgacacaatcgttgagtgatgtttctcttacttataacaaaaaagttatggtcgcagaaacttcgtatccatacacctatcaagatggggacggatttgggaatacaatttccaaagattctaatgtggtattggattatcccgtatccgtccaaggtcaaactacggctttgcgcgatgtttttcaggctgttgcaaatgttggaagcacaggattaggtgttttctattgggagcctgcatgggttcccgttggaccgcagtcgaatttagaaagtaataggctattatgggaaaaatttggttccggatgggcaactacaaatgctagcgaatttgacgcagatgctgagaagaatgcaggtggatcgtcctgggataatcaggctttgtttgattttaaaggtaaagccctaccttcgctaaagacgtttaaatatatagacactggtcattaaataaactggttgaaataatgtttgattcattgtgaattttatacggtgattgacattattgtaatcccaaattttaatttctggtgcaatgatttttacttataaagattgaaaggagaagcataatggcggaaattgatttattcacagcattcgcaaaaaaaatcattgaagaatctgattatacaattgatgacgaaatttatttggtcaatcaaattatgggattagttggtgaaacaaataataatacggcacctcgcttggtagatgatgacagtgtaacgaccctagctttactagatcagctgacagctgttgccgaaaaaaatgggacattagcgttgcgtcagatgaacactgatatgctaggtgcgcaactaatgaactttatcgtaccaaggccatcacaggttcgcaaaatgttttgggagcactatcagcaatcaccacggaaagcaactgattatttctttgatttatcacagcgtagcaattacatcaaaacgcgtgaaattagtcaaaatatttcttacccggttgatacccagtatggtacacttcaaattacaattaatttgtctaaaccggaaaaagatcccaaagcaattgcggcggctttgaaaaataaaaaacaacagcaatcacagtatcccgtgtcacagttggcaaaagagaatgaggggtattggggtcgacttgattatgctgctcgcactaatcaccgtgttattccaatgatattgggacaagaaaagtggtattttcagtattcgccttatgcgtattttaatgaacatgctattgtgctctctgaaaatctccgtccaatgcacgtggatcgtgaaaatatgtcacgattgttagaatttgtttctaaatttccagagtatttcattggatcaaacgcagatttgccaattgttggtggctcaattctatcacatgaccattttcaagctggtcgctacgaactaccaatggcaaaagcagtcatgaaagaaaaaattaccattgcaggttgtgatttgcgtgaagcgggtattttaaattggccgatgacaaccattcgcttgattgatgatagtcgcgataaattactgaatgctgctgataaaattatgagtgcttggcaaaattatgacgatgcatcactgtcgatttgtgcttatggatctgatggtgaaaggcaccacacggtgacgccaattgttaggttccgcagtggtcattacgaagtagatttagtattgcgtgataataatacatctgacgctttcccagatggcatttttcatccacatccagatgttcaacatatcaaacaagagaatattggcctgattgaggtgatgggattagcaattttaccgccacgtttaaaaacagaattagctgaagttgcgcaatatttattaggtaatgacaataacattgcagtgaaacatcaagcatgggcagatgctttgaagcaatctgaagtgattaacacgaataatgtgacacatatcgtgcaacaaagcgtgggacagattttcagtcgcgtacttgaggatgcaggtgtttttaaaaacgatcaatctggacaagatggtctgaaaaagtttattaagcaaatcgaagtaggggaataaatcaaaatggcagtattagtacttggtggcgcaggatatattggctcacacatggtgaaacgtttggttgaagcaggacgcgacgtggtggttgtggacgccttgttcactggccaccgggcagcagttaatcctgcagcgacattttatcaagttgacattcgtgataaggcagctttgtcggcagtgtttgataaagaaaacattgaacaagtggttcattttgcagccttttcaattgtgccagagtcagtggcaaacccgctgaaatattttgacaacaatactagtggcatgattacgttgttggaagtgatgaaagcacatgacgtcaagcaaatcgtcttttcatcaaccgccgcaacttatggtaatccggtgcatattccgattaaggaaactgatccccaaagtccgattaacccttatggtgaatcaaagttgatgatggaaaaaatcatgaactggtccgatcaagctgacggggttaaatgggtcgcgttgcgctatttcaatgtggctggtgcagcagaagatggcacgattggcgaagaccacaatccggaaacacacttggtaccaattattttgcaagctggtttgggacaacgtgattatattgaaatgtttggcgatgactataatacaccagacggctttaatgtacgagattatgtgcatgtcttagacttggcagacgcgcatatcttggcattgcagtatttagctgaaggtcatgagtcaaatcagtttaacttaggatcagcaactggattttcagtgaaagagatggtcgaggcggcacgggaagcaacaggggttgatattccggctaagattgggccacgtcgagcgggtgatcctgatattttgattgccaattcagacaaggcacgagaggtgcttggctgggcaccaaagtatgataatgtgcaagacattatcgtgacagcttggcagtggcatcagagtcatcctaagggttatgatgaacgacatgaggatcaataacaataatagtggagataacaatatggaatccaaaatatatagagaattagagcgagaatttcaatcaaaatttgactctcaacccagtgattttttcttttcacctggtcgaatcaatttaattggtgaacatacagattataacggaggacatgttctacctgcggctataacgattggcacctatggtgctgcaaagtctcgccacgatagatttgttaaactatactccaaaaatttttcagatgagggcgttattacttttgatattaatgatgaaaatcatttgcagaaaggctcatgggggaattttgtaaaaggtgtgcttcaatcattgagattgtatggtaataaattcgaccatggatttgatctagctattgtcggtaatattcccaatggatcaggattatcttcatcctcgtccttagaattacttgctggaattgtagtaaaaaagttgtatgatctaaaaattcctcgtctacaattagttgctagcggtcagaaagcggagaatgactatattggtgttaatactggtattatggatcaatttgcaatcggatatggtgaaaaaaatcaagcaatttatctcgataccaatacgatgatttacgaacttgttcccgtggaaatgcgtgacaacgttgtagtaattatgaacaccaacaagaaaagagagctatccgattctaaatataatgagcgtgttagagaaacccaagaagcggtctttgacttacaaaaagaattgagaatcaattttttgggggaaattgacagtaaaacatttgaaaaaaacaaacatttaattaatagagaagttgtggcgcgtcgagcgaaacatgcagttagtgaaaatgaaagaactaaaatagccgttaaacttttaaaagataatcatatgatggaatttggcaggttgttaaatgagtctcatgaatcattaaagactgactatgaagtgacaggaattgaacttgacaccttagtagagactgctcaaaaagtcccaggcgttctaggcgcaagaatgacaggagcagggtttgggggctgtgctattgctttagttaataaacaaaatgttgctgaattaaaacaaatagttggaaaagcatacaaagataaagttggatatgaagcttcattctacgtcgccgaaattggacaaggagttcattcaataagtttaaatgctggaaaatagtatacttatagttattaatcagcagttgtaaatgctcttatactaaaaaacttactaacattaaaggtgaagattattctcgacggagatgatcttcaccttttttagatttattctaaaattggtagtgaaacttaggtcgttggtccttttggcaccagatgtcgtagaaaaaaatggccacttcactggctttaccacacaatttgatcttagtaagttaggcgctagacgtcgagtatagaaaattaaatggtcgtgaggtttcagtggttgtttcaaatattttttaaggagttgctattatgcactatgttattggtattgatgtctctaaagctactagtcaagttgcggtggcggttgatggtaaggtaactcaacatttcaagataacccatgatgtcctgggattcaatcaactcaatacaattatcatgcaatttaatgaatttcctgatattgtttttgaggcgaccggtatttattcgcgacgattgaaatcatttttggattggcataattatccctatacttatctcaatcctttagcagcaaaaaaacagttggatcagcttcgcccgaataaaaatgatttgaatgatgctaaaaacttggctgagacccaattcattttagctcgtgctaaaagttatgttcaaaatccaatttatattgagttacaagatatgagccgcttttatcaacaaattaatcatgatattgtcagtacaaaaaatagattacatcgcattttacaactgacctttcctgaaatcgaaggactcttttctgccactgatagtccacattattgggaactcttaacaatagtgccacatgcaataattacaagacgttcgaggcaagcattcatggacacgattcaaggtgggattagttggcatatcggtcaccagagattatgtaaattagtcgatcaattaatgagtatgggtcagatatcagcgcctgcagttgctgccaattcttataatgttgcacaggttatatactatgccaagcgtttgattgagttgcatggtaccaagagtgacatcctgactgctatggtagataaggctaaggatttaccggaatacagcatttatcaaagcattccagggttttctgataaaacagttgtgtcgctgatagctgaattgggcgatttacatcgtttccgtactgcaaataagctaaacgcttttgttgggattgatttgagattcaatgactcaggtgattacaaaagcacaggttttatcaccaaaaggggaaatagcaccgcacgcaaagttctatttagagcaatatcaaatatagcaagtaccgcatcttatgggcatcccagtcatattaatgattggtatcaaaagaaaaagcaatcttcattgtctaagggaacaaagaaaattgccattggtgccatgtcgcgattactgagaaccatgcattatctagtcattaatcatcaactgtatgattacaaagctgtatcaaagcatggatgtaagctgattcctgagacaacttttaagagagcgtataatgaataaatcatctctcaaaaggaaggaatttttacatgccaactcgttacgacaaagaattcaaacaaaacatcatcaacctatataaacaaggcgaatcagccgcccaactggccagagaatatggcattggctattcaaccgttcataagtggatccagggccaagccaaaactcaatccggtaaatcgccagacgtaattaaagcgatggaaaagcggctggcttccctgtctgaggagaacgaaatcctaaaaaaagccctgggcttccttgcgcagaagtaaccaatatttttgattatattcaccaagaaagtcataaccaccaggtaactaagatgtgccgaatcctcggtgtttccagagctcactattatcgttatcgatccccaaagccttcaaaacgccgggccgaagatgaggacttaaaacaacggattctgcggatctttgcggaattcaagcagcgatacggcgttatgaagatccaccatgaattgaatctggaacttcaaccactgcagcgtcggtgcagcccaagacggatttcccggctcatgaaggaactggatatccactccgttaccgtcaataaatggaaagcggcttcggcttccaaaaccaaggttgaacagcgtcccaacttgcttaagcaggatttctcgaccactggtttaaatcaaaaatggaccgctgatatgacctatattcaaacgaagcgtaatggctggtgttacttatcaaccatcatggatctgcactcaagacgaattatcggctattcattctcaaaaaagatggatactgatttagtcttaaagaccctggaaagcgcggttaaaaatcgaaccattactggggacctgattatccacacagacttaggatcacagtacaccagcgatgattacaaccaacggttaacagaactacatatccgccactcttacagccgtaaggggtgtccatacgataatgcaccaatggaatcttttcatgcttccctcaaaaaggaatgtgtttatccagtgccggtctttaagaattatgaaactgccgctgctgtcctttttgaatatgtgcatgctttctacaataggaagagaattcatagttcactgggctaccagacccccttacaagttgaaatcgcaacacttacgagccaaatggccgcctgatttaatgctttccatggttcaaataagttattaatcacgattaatgatttatttgagctgtggaaggtaaacgcggttctgaatgtctcttaaaacctgtctcaaatattgacttcaatccaacaggagattaagttactatgcaaacaaaaacaggtaagttgtttgatactgtaagcaagacaatagataaacattatcccaaaggttggggtggagcggctggtgtgttattagaaaacggcgatattttaactagtatttcgcctgaattcccaaatgcagcatcaagtgtttgtatggagctaggtagttatattcaagcagctactttaggccagaaaattacacataccctttgtttggtaagagaaaatgaacatgatagtttaaaggttcttaccccttgtggtatttgtcaagaaagattaaatttctggggaaataccacacaatgtggcatcgggattttaaaaaatggtgaagtccaatatatgccgcttgctgatttacaaccttttcattggagtagggtttatcaataacgcattggaatataaatcaattgaatattttaaagtgaagtgatgccactgtataggggcatcacttttttgtaaatttatattagatggcctgaattaacgaatttgttttcagtatctatcatgtatataaataattaattcttggaatttaccattaacctaatttcagaagaaaaaagtcaaatatcttgaaatactgaactttaattttatgagctaaatagaaatagtgcatttttttattatgagagcacacatctgtccgtaatttaagtacgcttacttggcactgttctggttgacgccgttcgcgagcatatcagaattagttaagtgaatatttggaaagaatagtaagtagcatcctttcttccgaggtcagtagatgattttttctaaacgctatgctaccaacaaatttaggttgatgatcatcctttattgataatgtaattatgtctggcattgttggtttaacgatatcagctaacaaagcaataccaagattttccgaaatcatattcattaaaaaattaatatcggacgttttcataaaaaattttggtctgatattacctgtactagcaaaataggccatagctcgattatgaataaaactagaatcgagaccaacaaagtgttcggattttaaatcagaaaaagataaactctccttcttagaaagtgggtttttactagagacgtatattttaaaattggcttgaacgaaaggttcctgcaataactcattagtaacgtcactatccaatgagcctaacaatgcaatgtcaacatcgccatctattagtgatttttttaatacattagatccagcttcaaaaatgtgcatattttggatattaaattgcttatcaaattctttactagccactgcaattttagcaaaataggcactctttagcattggtggcaaaccaattgttgtactatgtgattttaagtgattcagttcatgcatggcagtttctatttccgtcgtaatcgaatgggtgtgtctatataattgttcacctgctggggtgaattttagtgcattttgtgagtttcctcttataactaacttactttggaagtgagattctaagcgctttaaagcagtgctaatagatggctggctaacattaaatgtttgggcgactttggtaaaacttttttttgtatataattcattaaagtatttgaaatcttctgttttcattagaaacccctttatatcaatgacaatcatgatgtatataaaataaatttatagtaaccagctagtttgactataaaacaattgaccatgtatagtcaaatatgttgttaattaaaatacaaaatttttggaggaaataacatgactacaacagggtatagcattttgcgtaatccatttttaaataagggaacggcattttctgcagctgagcgtgagcaattgggcttaactggcacattaccaagtcaagtacaaacgattgaagaacaaacagaacaagcttacaaacaatttcaggcgaaaagtcctttacttgagaaaagaatatttcttatgaatttgtttaatgaaaacgtgacattgttctatcacttgatggatcaacatgtttccgaattcatgccaattgtttatgatcctattgtcgcagagtctattgaacaatataatgaaatttacactaatcctcaaaatgcagcatttttgtcaatcgatcatccagaaaatattgaaagtacattgaaaaatgtcgctgacggtagagatataaagctagttgttgtgactgatgctgaaggtatattaggcatgggagattggggtgtcaatggtgttgatattgcggttggtaaattgatggtttacacagcagctgctggaatagatccagcaacagtattaccagtaagtattgatgcaggtacgaacaatgaaacgttattggaaaatcctttgtatttaggaaacaaacatgagcgtattgctggtgaaaaatatcttgaattcatagatatgtttgtgactgctgaacaaaaattgttcccagaatcattattgcattgggaagattttggacgttcaaatgcacaagtaattttggataaatataaagacagcattgccacatttaacgatgatattcaaggcaccggaatgattgttttggcaggaatattcggtgctctaaacatatcgaaagaaaaactagttgatcaaatattcctaacattcggtgctgggacggctggcatgggaattgttaatcagattttttcagaattaaaacaagctgggctatccgatgccgaggctcgtagtcatttctatcttgtggataagcaaggattattatttgatgacactgaagatttaactgaagcgcaaaagccgttcacacgttcaagaaaagaatttgttaactctgaacaactagacaatttggaagcagtggtcaatgagatacgtcccacagttttgattggtacgtcaacacagccaggcacatttacggaagcaattgtaaaatcgatggcacaaaatacagaacgcccaattatttttcctttgtcaaatccaacaaaactagctgaagcaactgcagaaaacttaattaaatggactgatggaaaagctttgatagcaactggtattcctgcagcgaatgttacctacaaaggagtgacatataaaataggacagggcaataacgcgttgatttatcctggtttaggctttggtcttgttgcctcaactgctaagctgttaacacaagaaacaatctcagctgctattcatgcattgggtggtctagtggatgctgatgaaccaggagcagcagtactgccaccagtttcaaatcttactgagttttcacaaaagattgctgaaattacagcacaaagtgttctaaagcagggacttaatcgtgaaaaaattgccgatccaaagcaagccgtacaagatgctaaatggtctgcggagtactaattaggacttaaataatatgacaaaaataaaaatcagtggtgtcagcttgccgttgtatattttgatgctggtcatacttggtgtcacaatttcactcaacaagctgccacttaatatgcttggtttaaccttgttattggttctacttggtcatctattctactacattggcaatattttaccagttttcaaatcatatcttggtggtggatccgttttcaccattttcgcttcagctgctctagcaacaagtggcatcataccttcaaacgttgtgaatgctactaagacatttttaaataaccaaggattactagacttttatatcgccgccttaatcgttggtgcgattctaggaatgaatcgtaacttattgcttaaagcggctgtcagatttatcccagtatcattagcagccatggttataggattctttgctgttggtctcgttggtatgttactgggacttggattcgggcattccgtaatgtttgtttctatgccaatgatggcaggtggtataggtgctggagcggtgccactttcgcacatttatgctcaaggtttaggtgtcagttccgcctcaatgttttctcaactaatacctgccgttaccttagggaatgttcttgccgttattggtgcagcattaattgcaaaagttggagcaaacacaaaatacgatggccatggtgttttattaccaatcaatgaggacgagaaaagtaaaccaataaagaatctagacgttactcgtatcggagttggcatgatgctagcattttcgttcttcttggttggcacaattttaaatagttttgttccaaaaattcacgcctatgcttttattattatcttagttattatcgctaaggcatttaatttgattccggatcagcttgaagagtcagtagtcatgtttaacaaaattataatgggtaacttgacacacgcagtattggctggcataggtttggcgttaattgacttgaatgtattggaacaatcattgacttggaaatttgttcttctcacgcttacgagtgtcgttgtaatgggtgttgcgagtgccgtgattggaaagctatttgggctttatcctgttgagtctgcgattgctgcaggaatggcggacaatagtatgggcggcacaggtaatgtggcggtattatccgcttcaaatcgaatggatatgattgctttcgctcaaatgggaaatcgaatggggggcgcaatcgttctaattttgggaggagtattaattcattttttgcactgaaataccataattaaaaatcatatataaaatagcctcttcagcaagaggctatactctgaatcgtaatgaaaattacgatttttttatatatttaatgttgtgttcgaaggattaaatcaacatttagatatctaagaacaaaaaaattggtagcttctttaaagagttagacgacactattggacttcgttattttatgttagatttgctcaaagaacagaaaaaggtttcaaagcggttaaaaataaggttgccaaaaaaactttcacaaagtctttggaagccttattttaatacctgttttttaaaatttcacaagtgtttgagttttagaccaattgctattttagggtgtgttatattagttaaagcaatcaagttaagacggtggctatcctgaatggaggtggcgcttatggtgtaaacactataaacacacattctaggaaaggagaggccttgtgtccatatcggacgcgctactggtcatgtttgcctttggtggatccatcataagcttctgacttttgtagttttgttaatcgaaaaaattagcaaaaaaaaataaccgtcttatctttggctgataacggttatttttcaagtaactaagatttagtcaccgtcgaaacgggattgctaggagtcgtagttagcgctacggctcttttctatgtcttcattatagcatagcttttgattttgtcacaaatttaatgttttgttcgcttgcttaatcgaacatttgttcgtacaatggattatacacaaatgtttttggaggttgctgatggaaaacgcaatcacaactgaatatgattatagcaaagaaaaccgtggcgtgttcttcctaattgattcaaaaagtttctacgccagtgttgaaaatgttgagcggggctttaatccattaaagggcgatttagtcgtgatgtctgaacaagcaaacacgaatggtggtttagtcctagcggcctcaccaacagctaagaaggacttaggcatttgtaatgtgatgcgccagcgtgatttacctgatgtgcatggcttgtttatcgcacaccctaggatgaataattatattgctgaaaacctaaaaatcaataatatttatcgtcaatataccgatgatattaatttgctgccgtactcgattgatgagtctattttagacgtaacccactcttggcggttgtttggtaaaactcctgaggaagtcgcttttaaaattcaaaagcaagttagagcggaaacgggggcctatttaacagttggtattggtgacacgcctgtgctcgcaaaaatagccttagacattgaagcaaaacacactaaaaacctgacgggtatttggcactatgaggatgtgccgacaaaattgtggccaattacgaaattggatgatgtctggagtattggttcccgcacagcacataaacttgaagtgatgggtatccattcaatgtacgatttggcgcatcaggacccttatcaatttagagcaaagatgggattagttggtgagcaattgtttgccttatcttggggcattgatcgtactgatatgactgaggtggtcgtgcctaaaagcaaatcatacagtaattctcaggtattaccgcgtgattataaacgaaaagaagagattgagattgttgttcgtgaaatggctgatcaagtggctaccaggatcagagcacataagaaacaaacttgtttggttagcttgttcatcgggtattcttttgccgaaagtgaacgccagggaagtcatggttttagaaaacaacaaagaattgatcccactaatgatacccacaaactaatggcaattatggtggctttgtttgaaaagcattggcatggtgaagtgattcgtaatattgggattgattatggcggcttaattgaggacactggcgtgcaacttgacctctttgagcaaccagaaaaatcaattaaatccaacaaaattgatcaagttgttgatgaaatccggaaacggtttggcaccacagctctgatgcgggcgatgtccaaagaaaaaggcggtacggctattaatcgtgccagccttgttggtggtcataacggaggtaacagctatgagtgatgcagaatttagtaagatgattaacaattactttcaaaacgactatcgcgagcgtggcaaggtgaagtggaatggctatttcctgtcggaccatacctcagccttaaagcgtgaagcacaagccaaaaatgcagtacctgttaaattaccaatgatgtccttaacggcttgtcaaaatatcttgcgtcatgcctcagcgaattatgaatttgtaactatacaacaaaatatctcagatgcagatggtaacctagtgccaaatctaacaggcttagtagatggtttctctgacttgggtgtatatgtgcaagagacctatattgcctttgaaaatattagagcggtggtgaaagaagaatgaatcaaattgatgctatcattgaagatattaaaaagatgtttgctaaacaacctaatacaatctatgaagtaagggtggtcaatcagatatactcaaagaaggtcaatattttctttgaatactataaaattggcaaagcaacacactcacaacaaatagctcgcttagacagtgagtacagagaacagatacctgaaatcattactaaaattcgcaaagaaactgggctaacagttaacactaatatttaaaagcgttactcaaaagatgatataatacacaagtaaatgataccagtggcatttacaacgcgcttaaccattggataccgaatgttatagttcggtaaaagctctgattatcagggctttttattttgttatgaattgtgatgacgcggccaatatatcattagtgctaaggcaagtgacagaatgagaataattagcaccagcatcactaagatacttttgattccaaaagcaatagccagacttatcagaataataagtggtaaataaaagtaccaatacgaaatcaaatgaccaacaaataggatactcaaatacaggatggtgccaatgatgtggccgaacagccaaaacaaaaacattgctaataaacataaacaaaagattaacatgctaggttcctcctaatcagagagtcgtgtgagacaaagtgaaaagagctcctttgtcactgagggataattcaataaattcttgatcccaaagtgcgtttgcgtataagcgcagaccaaataaccaaaataccaatcatgacctgattcactcagaccatctgggaggtcaacaaaaagacgttgcaatcgctttaaaatgcgcggaccaaaaatagcatcgtcaaagattgcttgtgctaaacctgggtagatatattggccattgctttctaaaatgactaatccgttagcatcagtagtggtagacaatgttttagctgtgaattttgacatgagttttctccttatggggcagatgtccagtgtcgatccagcaacgcgtcgctttataagcggactgcttaaaagccaagcatgctaagacataaaagccagccagggtgagcaagacatacagcatcgtgccattgatgaccatcctgaggacatccacactgataattgatgcggcaatagtggtgataacttttgtaatttgattcatagtaattctccttgattatgtacgcaccaggcagaaactgtttcctgtcggccctgcctgtgattggtgtgttatttcgttttgacgaagaacatggggacacaagcagcgcagaatacaagggtgagcgtagcgaatttacgaagcccttttattctgtgctagtgcttgttgctgtggtatcatcaccacagcttacaagtcactggttgtggcacaatgtttggctcaaggcgaagtggcacccaagagcttggcaggacaagcgcagcgtgtttgatcccgcttgcgggtctggggaacacggcaaaagattttttaccgctcatcatcttcatgtgcaatcataatcacaccaactatgtaatagagtatgtaaaccaataaaatgattaacacaaataattcaaaaacaaatgtccccatattgccacgctcctatttgtgattaaaattcctcgtaatccgttgtctcttgtttgtactccgcactgatttcacgtaaatctaaatcaactgctcctaaaatcactttttcatcaaaatagtgacgtttaccaatttcaatagcttgtttcagcttttgctcatctgtgagtgtatctgggacatcaactgccactgttttaaccaatgtttccatatatttaacgttgacgattgccatattattctccttaaattgtggttcttagggtaacgtgtttaccctcagccaattcttccgtgataaatgcacttaatcgcagtgcttcatcatctgataaatctatttcacttgattcattgctagtggactcactgacgtgaatttcactaccgcccatagggaattcatcagaccatgaaaagtaacgtatggctatattttcaatcacttcatcattcattgtcattagtctcctgttggttttgcgtgtaataagtgagtccgttttcttcaacttgattgaacatttggataaagtccttatcaagtatatttttctttttgttcaattcaaattgtgaccaagtaaattccattgcttgatattgactaggggtaatactgctaggctttactttggtatcaaggcagagcatagcttgataaaacaacttgggactttctttttgtaaagcttgcaaagtgttgaaaatggtgttgaccaatgaaacactaacactagcttcaacaatttcttcaaagcctttacttaattgcgctttatagtgactagttggcactttggtttcattgaacaaataagtcatatcagcgattgattgggccatttttgcgattggtaatttgctaaaatcatcataaaattgctttgtcattattttttctccagttcatcaacattgactaattgaatattattgccgtattgggtggctaaaaaggcaaacgtgtctttcaaaatataatctttagaacgattaacgccatagatttgtagataaacggggtagccatgagtgaggccaacttgcttatcagtttaggcataacgaacggtatgaccgctgttacgaatgagttgataataaacttccataagaaataaacctttccaaaactttttcctgttggcaatcgctccaattgagctggttgcgtcgtgacgggtaacaattggcatgataaccaaagaaacacaaggattgcgcagcaacttgccacgtccttgtgtttctttgtagagactgtttggcgcttgcgccttacagactctttatcatgcgattgtgaaaacggcacaaagcaaacagaacaatttggtgcgatgcgaacggaagtgagccttttgaacccccaattaactttactggtgtggtatcaaccacgcctgtcaagttaatgatcagggggactggggggaagggctatgactaaaaaatagtcatggctttttttattgagatattgactgaacaatagggtcaagaattgtatcaattgaaacactcgctaaaatgtctccataatctttgaagtaagttccgttatgtctcgctagaccattactagccacggttatttcatcaccattttttagggttgcaatcatcacaccattggtagtgattagcttatttaaaatttcaaatgggttattttctgtcattttgttgctccttgtctgattttggtgagtgatagtctgggttgtttagccaccaggcattcatgattttaaacaactttttacgaatggttgctgcactggcttttgggttgccacatactagtgctcttatactaaaaaaatagtccatttttttagtataagagcactaattcaaagcgtcttacaaaccaatctctgatttgattggctttacgccatgagtgaataatgacggctttacctgtttgcttgttctctgtttgtaaatacatatctaagcccatagtcttgtcctcctgttggcctgttttgtgaccaatttattcttattgcgttgtgaacggacaaactaaaacaagccagggcgggtttgcaaagctcgcgtagcgacacgcagtgctaggccttgcaaatttagcccaaatctttggactttagtccttagatttgcttgacttgttagagttttggtagtcacaaaagcaagaatagatggtgcataacagccagcaggcaggaaagccatcacatttaaacggtttgaaaatcgtttgaatgtgatggctttttttgaacccccaattaactttactagtggggtatcaaccacgcctgtcaagttaaagattagggggactggggggatttgtgttgtctcaggaaaaaccatttacttttatgaagttactcaaaaggttgatatattgaccctatattaaacaaaaagggagctacaaaatgtctaaaaaaacgattgaccaacaaattaaagaaaagcaaacacgtttggatgaactagatttacaggcaaaagcaattcaagacgaaaagcgggcgatcaaaaaagacatcaaacaacttaatgatgcccttgtggctgaattgggacggtcactgttagccaaaatgaacttggaaacagatgatattgatcaggcatttgctgaattgaatcacttaccaattgacaaacaagttggaggacaagctcatggcgatcagtaaagaagaacgtgcgcaactcaaactattaccaattcgtggctattgcgattggaaaggtattccatacacaacggataccccaactgagttacgtatggttgatcatgacagtttagttgttaggacaaaattaaaccgctttgtctggaactcaactggcgttaaaggtgacttggttgatttcatccactactacgaattaggcaaatcagacggtgacagcaaaggtgccgctattaaaaatcaactggcttacgcacgctttgtcaaaggtgaaaatattgatgtctctaaactgtacgaagacaatacaccgcgttacaagtttgattatgacaaggtcttcaaaactcaggaaacaaacgtcgccaaagattatttagttaatcaacgaaaactcaattcacagttcgttgacaatttattgaaaagtggcgcagtggtacaaggtagccgttatcatgaaggtgataaactacatcaaaaccccgtcatctttccctggaaggatgttaatggcaaaattgtgggcgctgatcgtcaaggaactgaacaagactttgaacattacaaaaagcgtggcacatccaaaaaaatctttgctggcagtgatacctcaacaggctataacctctcttttggatcaggtgacaaaacattgatcttatttgaaagcccaattgatttattgagttatgcccaacaaaatcatcaagacatggtgaaaagtaacgccacactattgtctgtgtctggtactgatgcgaaacgtggcttgcaatatttgaatgatgcggttgctgctaagcaagccaaatttaataagattattgtggcttttgatgacgatgtcgcaggatttaaagccgctgattactttgatcgttttagttttaaaaacccaattactggtgaagcgattgaagcagagcgtcatattcccttacaaggcaaagattggaacgaacaacttaaagcaggtgttacagggcgacgcgttatgagtatgacagataatgctaatcgcttagatgccttagaaaaacttgcagtgcaagagacacaaacaggcaaaccagattatgtggatgtcaaaatgagtaccattcaacctgttaaggaagtctcagacataaagtcaaacaagcaaacaaataaacgtcgttctaaagctgatcgtcgtaaggaaaatgctttaaagaataagcagattattcaagaggcaatgggaaaggtggctaagtatcaacaagatcccgctgagctcaaaaagctccttgactttaccgctactggcctaaattattcggctcgtaattcaatgttgattcaactacaagatccaaaagccaccttgttaaaaggctacaaacaatggtctgctgatggcattcaagttaataaaggtgagaagggtatcaaaatatttggtgcccctaccaacttaaaaacaatcattgctgccaatggcgaaataatacgctggtctgatgcgacacctgaacaaaagcaattagccaataacaaccaattggaagtccgcagtgtgaaacattatccagtcgaaaccgtgtttgatgttcgccaaacgaatgccacagctgcgaaattgccaagtatgttacccaatcgtccaattgacttagccactgataaaagtccaaaacatttggaggcggcctataaaacattattgaagttcgccgacaagcttaaagtgcccgtcattgaccaaggtgtagacgaacaaatttccaagcggccaatgacctggcaaggacaagcaaaaggcgcctttgttcaatcaaaaaccaataaggatgaaaaatatatcctgttgcgcagtgatcttaccccaaccgataaaattcacaccttagcgcacgaaattgctcatgcacagcttcattctttgcagagtcaaaataattggcccacagcaattaaagaaacgcaggcagagttatccagctatgtgattactaaaaatctaggcattgagcctggtgagaaaagcgttgattatattgcgggttggtcaaagaatttaaaggcgctagagggtcaaaatactggcaaaatcattagtcaagcactcaaagctagtaccgatgtgacacagtatctatcggataacttgagcaacggtgaagtacgccaaccaaaaacaacaaaattgcttaagcctgataagttagcggttgtcgaacaaaactatcaggccattaatcaaacaagtacacgacacatgtaaaaggagtaaacacatgtcacaagaaaacattcaagaagttacaggctttatcacaggcattacaaagtccgctgaagttaatattttatccttccaggaaaagggtcaaccaggggccattgcattgacaattgaaaccagacgctaccacgaattattcccagcaggcgacccaattttaggcattgaaatggtggccgtattacaacaagttggcaagaaattacaagtggtgtcaatctatgatcccgaaggtgattttattgccgctgatgaagtgccagaacttggccaattgaatcatcaattagatgatgccaaaagcacagatgtctacacaagtttactcgctgatcgtcaaaaagcagttgatcacattgaggcgagtacaagcgaattagaagaattagccagagaacacgatgctgcaaagcaagttccagaaagcaagacgaattatggtgatcccgtcaccgaccagggagggaatgaatgattgaattaaaacaaaataatcccacaccttaccttgaccgctatacaacagacatcagtgctaaagtcatgcttgaaccagacaaatatcatgcttatgaacgggaaagtattacgcgtcgtatcatggtctcactgatgaaacaaattcaaaatgcgcctttattagttgggttacctggagttggtaaaacagctattgtagaggatttggcacgccaattattaagtacctcagtttcttccctcaaaggcaaacatttagttcaaattagtttggccaacttgatgaaaagcagcgatggtgaatcatttgcgcataagttccaggcaatcattgatgaattgattgccaataaagacactgtaattgcttttattgatgaaattcatcaaattgttggcactggtgctgaaacatcaggcagttcattggatgcgggtaatattatcaaaccagctctaagtcgtgatgatctccaaattattggagcaacgactacgaaagaatttcacgaatatgtggcgcgtgatggcgcactgatgcggcgatttgatttgattgaagtgccagaattaagctttgaacaaacgaaaaacgttttatctaaagtcgccacaaaactaaataacggtgttgaagtgccagagattgttcaagacagaattatggcactatcacaacgctatatcactgaccgttactttcctgaaaaggcaattatgttgctagatggtgcgttaagtgtcgcacgattagccaataaatctagagtggaagacacagacgtggctacgattatccatgatgactaccatgtgcctgaatatgtcattaatcagacgactgatgaacgattattgaacctgttaccaagattaaaaagccaggtgattggtcaagacacagccttagaaaaagttgcgatgaaactgactaatcgtgaggcaggactggccgatacctcaaagcctgaatcatttctctttatggggccgactggtgttggtaagactgagactgccaaacaactagcgctaaatctatttggtaataaacagaactttattcgatttgatatgtctgagtttaagtttgcagggactagcctagaacggtttaaagatcaactcaccactagagtcaggcacacaccttatgccgtattgttgttggatgaaattgaaaaggctgatccagaagtgatggacttacttttgcaggtcttagatgatggtcgtttgagtgatgaatatggtcgggtcattaactttaaagacttaatcattgtgatgacaaccaactcaggggcaacagcagtgatgaatcgtgatgccaaatcagattctgttaaagaagacaaaaaacgtcaagccaactttgaagaacaactcgaaattgccttgcaaagtgatggttaccgtcctgagtttatcgctagaattggtgccattattgtctttgatgtcttaaagatggcggatatggtgcgaattgttgaattgaagttgtcacgtctcaatcaaaaagcacaagagagcggcttcaatattgtttttgacacacaagaggtggcgcgctatatcccatcgtttgacctgggctttgaatatctgaatgacacacaggaggtcagctcaccaattgccaactacatcgcagatgttggttataaaccatcgcgcggtgtcagaccaattgatgacacgattgccacgtatgtgagtgatccagtgtctgccgcaattattcaaaagcgacaaggattagggcaggactttgatactttcatctttagagccattggtaatccaccatctttgacaagtccttatggtgaatggcaagttgtggtttccacagctaaggaggcaacagacaatgaagctatttaaaaaagattatcgtgccgaaagacagttcatgcgcgaaagttacattcgttggcgtggtcgtccctggttcttatggttgtatggcatcatcgctacaattggtgtcatcgttgtttcattgtatatcaccatcatagttgatttgattattcgcattgttgggccatacgctcaagcttttaagctctatattcaaagtggtgttgcgcaatggcctgaattcaatgatgtcatgaacatgaccgccaatgtactcaatccactcaatatttttactattctgtctcgactaactttagtgacaagcgtggtactaatcatttgcttgttactcctactcaaaaaatatgtcttccaacgcatctatgactggtatcaattgtttagagaccaaacacgaaacactaaccgttttgcggaagtccgtgaggttgataaggtttataaattgattcctgatcgtaataaaaactttaagggtcgcccaggacaaccagtgttgcacacacaaggatacaccttcgaattctttatgattcatccgttcctgtgggcgtggcaatggttcaagcgcccgcttggaatgaattctttacaatttggtggtatctacaaaaaaatacgtcccgttttattggaacgtttgccaaagttatttgaaaaacaactgaatgttcaaggcggttttgatggtttttattgggtggataccagtaacacacattcaaagaccactgggatgacgcgttcttcaaaagaccaaatgcgaggctataccttaattgacatcattcgtcgtgccgaaatcaaatggaacattattgatacggatgccaaaaacgaagatgccaaaatgagttataagtcattacgcacagcgggctatgacgtgaaactacttaacatcatggagccaagtgagtctgagtcctggaatcctcttgaaattgcgattgattatgcctttgatggggattgggacagtgccaatacggaattacgtaaggttgtacaagtcattggtggttcaagtggtgaagaaagtagccacaaagatatttgggatagtgccgctgaaagcaccatccaagcagtcatgctaacggtgctagatattgcagtccgtcaccaggacaaatcaatggtgacaatttcaaacgttttgcaattcatcaatgatatgaacaagttcacggataaagaaggtgatggcttaactaagtacattactaacattggtaaactaccgcgaacaccagcgcgcaatatgattattctaaacgctgctgaatatctgtccgccacaggtgataccaaatcatcaatttctttctcagttatgaatcgtttgaatttatttgcctcagagtcaatcactcgtctgacaacctttaacactatcaatttgaccgacttagggtttccaagaatgctaaagattaagttctctgagcgctataaaggcgttcatgttagcattcatgtttatgaatcaggtaaaaagcatgcaatagaaaaggacaagctaactgtgtcccaatcaggcacgctaacttatccgattcataaccatttacccgtctcatggcaaattgagttgtcactcgataatgacggcaattcaattgcgatgcgtaaacaaaagtttacgttgactggtaagattgtacaacgaaaattgctcaatggcaagattaagcgtgacttgttctctaagcaacctgtcatccaatgcctggtcgatcagattaaaccacaaggcacaactgggacaccaggtgtcaccttgcgttactcagaaaatccgatggcagtcttcatcatcacgccacagtctaacgatgatttctctgctttggccagcttgtttatttcacaggttttctcagtcaatacggacattgcatcaacgattacccgcaggaaaatggacagttggatactttataaactcaatgagttctctatgtttccacgtattccaggcttcaccaatattctcacgcgtggtttaacctacgggcatttggttgatttgtatattcaaaccttaacacaaccacgattgcattattctgaagtggaaactaatgacatcaatggaaatacgggtaactggttccacattttaactaatgatgagtcaacaaatgaagccttatccaagcaattaggtgaggttgaagtccaaaccgaatcagtcaactcacagattggattagatcgtcaagatcgtggaaaccgtcatgcacaagttagcaaagttcgtttgctggatgccaaagaaattagtgaattgagtccgcatgagatgattaccatccgtacgatcaaacgtgcggataagaaggggcgttctgttcgccctttgccaattttctctacgggtccttaccgcatgccgtttgcttatgagttattgggtaagcagtattcacttgattactatacggcagacttgaacatcaaagcgcagcataacgatttgaaatatgatgacctctatcatgactttgtgccttactttgatgagctagatcaacaagttcaactagagattgaggaagaaggcgctggtggcaatcaaattgataatcgtcaactcaatacgttagctgatgatgaaatcaacaacatcttggccaaagcgcatcaaggtctcgaaacagccacagtgcaaacgcaacaagaactttctgatgaggaacgttacttgcagtggaaacatgactttaaccctgatgagccatttatgactgaggaacaactagataatgttgagctacgtcaaattgtagagaaatcgatcaaaatgaggataccgcgctcaaataagacagaagaacaaaacagtgccgttgcttacttaaatcgtggcaaatatctgacactttctggcaacaacaataacggtaaagttctaagattactaaacaacgaacccgcgtacatgtgggaaatatataagcagctcaatgctgcaacaaatcaaggagaagtcgaatgacaaatctattcacgggcatcaatacattagcgggtagtttaccaacgctacctaataatggcccaacagccgatttttacacgcaatggtcgcaatacctatcaccattgccacatatattcttaacgatgatcatgttattcatgcacagcattgcattgattttctattacatcgcggatgccgtcttctcagcataccaatcatcattcaagttattggactttatgaatatcttttttgagccaaatagcgatgtttatcgcgactggaatttaggtaatattctcaaagacttcttgtacctgggctttgtcatatttggcattatgatgatggtgcaatggatacaatataccgctacttctggtcgcaaaggtagggaatggcctaagggaatcaccatcacagttggcgtcatttcggcattacctttaataattagtttgctgagcggcattggaacagccacggttagtgatacatccggcaccaaagactataatattgtcacacaattatggcaggggaattccacagacctaggcaaattagcgaaaaataattttgatcttgacaagtacaaagattttatgaaaagacatccgattggccaaacaacaattgaaggtaataattatcactcagtaatgagtgatgccggttacacagacggtttaagtgatgctcaaaaatcagtattcaccaagaaaataggtggaaatggtaacatggtcgatattactggtgattcgctggttttgggtaaaacatttgcggatgattatcctgtgatgaaaacaaactggttaggcattattggtggcgaaatagtctttattatcgtcgtagccggggcgattgtacgtttgttatcgtctgtttataaaatggcattcatggcaggttcaattgtgtactttggcctcggagatggcacacaaggtaaacgtgtccagcaagtgctaggcatgattgagggacaaatcacaggtattgtcatgatgccaatttcactgattttcttcttcgcatgggtagaatttgcgttcaacactattaacggtttaggtttggatatgtggccatttactattttgtcaatcgctgcattattagcaggtgggaaagggcttgcaggtggatttgaaatgattgaacaatggactggcgttcgttcaggtcataatcctgttgcgtcaatgatgttagctaaccaagccgctcacatggtaggtggcgccacaagggttgccaagaaaaatattggcaagggtctcaacgcaatttcaccagaacagaaaaagaagaatcgtgaactaggtaagaagattgccaactcgggtggcaatcaaggtttagctaataataaagcactgactgatcacagcttaaatgatactggtgttgatgcctcagcacaagcaacaggtaaggcagccaaagccgctgaggtagctggacgtacagtaggggcaatgaagcatcctggtagtttattaaaaaacactgggcgtgctgctggagacaaagttaaagatggcgtgaacaaagccgttggcaatgttaaagattatgctggtggtgtcgccgacaactttgcaggaggacaacaagccgttgaagcctttaacaaacgtcattcacctgtcacaccaaaaacaagtacgggtgctacaccaagcaattcttctcaaccacgtaatgtccacgaggcactttcaaaggcggccacagattcacctaattcacacccaaacgatacaggagggctgatgtcagatgcacaccgtggcttacctactggaactgattcacccaagtctagcgctgctaatccgactaagccaattgtgagtggtggaacagttgttcaacctaagggagttggtgtaacaccagcaaccatgtcacgtccaaacaccccacgtttgagcggtacattgcctggtaaaaagacaataactaaaccgttgtcaccagcacaacaacaagaaaaggatcgtgcttgggctgagagtgtgattgcaaaacagaaagccaaaaaccaaactcaacaaaccgtatcaagtaaagatgacaagtgaaacttttaatttgtaggctaatacggtaaaatgaacagtagttgattttagggagtataccgatggagaaaataaagcaaaataaaatctggatcacaattgtggttattgggatcattgtcattgctattttgttggctatattgcaccagcaaaaacaaaacagccctgaggcacaatcatcaagttacgtatcaagtgccaaagcatcatcttcctcaacctccgttcaagataagagcaatgaaaagacctatgctaaaaaggctgctcaaatggatggtcacataattgtgatggatgatggatattattttactagttggagtgaaaaggactttcaaaattgggcgaacaattatctgtcaatgtcagaggattcccgacataaagatggagtacaggagagctttggaacctcttcaagtattgaaaatagtcgctcaactttatcgtatccattagactcttgggcgcaagacataaaagataagggtacaccatctgattattttgcaactgtgaaacaattcaataaacaatatccaggtgttaatcctgatgatataaagaaatagctaaaaagccatgatttaagtaatcatggcttttagtttgttctaaattattttgattggtttaatacttgctcaagcactaaatctacaaaggcacttgatgagcgaaatccttgtttggctgctaacttctcaatgccctgttttatctcagggcgaatggtgtaagtcgtttgtatcttacgactactatggtttgaagaaggtagtttgaatccgtcacctaacgatacttctgattgtggttcgtctcgactaaaggcatctgccatttgtttttgagcgctggcttcatcaaacatacgtgggtcttttttatcgtaatccattatttcacactttctaatagcttttgataagcctcattaatttgctgcaaggttttagggttacgcttggcttgttctaaatcaaacactggggttttaagcatggttgagctattaaagacttcgcgttcatttaagacagccacaaggttgtcaatctgatcaataatctggccaaattcatgacttgaacgggtattgtgcttcacacgattagcaaggtacaaaactttcgcttcaatcagtgattctcgtgttctaatatcaacggcatcatcacggaactctttcatccgtaggtcaaattgttgttttgattgaataaaaccatactctgagggttctaatggcaccacaacataatcagaaacggcaatcatattcttagtgagggtcccaaattctgggtgggtatcaattagaatatagtcatagtctttaatttcctcaaggtgatcttgcagccacatcatcatcaaaaagttcttattgttctttgattgtaatgtaccttctaattcatctaaatgaggactagcaggcaataaacctaattgcggggtaatttgtctaatttgtgctaaaccgcctgtaaagacgtcatatagcgtatttttattagtatagctttcataggtagaggacaagttaccttgataatctgaatcaattaacaagaccttgtagccttgtcgaaccagaaaacttgcgaagttaaatgtcatcgttgttttaccaacgccacctttagatgctgaaaatgtaattgttttactcatgataaagctccttagttattttatctgtcaaaacgaaataacgatgaaaccatcaatccaggcatgtaaaacttgtttacatatacattatatcatacgtataacatatatatcaatacattagactttaaatataggtataggtatgtttgtgttataagaggaacatatacacatatatcaatagaatatatagattggatatacaaaagataacattcaaatcattgcctcctgttcgtgcagggggctttttcttcgcctcaggaaaaaccatttacctttatgacattctttcgataacttgtacactgaccacagattgaacttcaatccaggcaaaaataacgtgttaaaggagaaattatatgtatgaacactttacccctggacgcaatatttggaagaaagtatctcggtggatgtttttcacgatggaacgaatctttgtcctagtcattgtttttgggattacttatttgatgattaagtctttctatccttacaacattggcaggtatggactaatcctgattatcagtaatgcgctgctagctggctttttgattttacctagtccaagcaatccaatgggtctcatgtatcaagaaattctacgtggcatcttaaaatctagcaagcacgccacaggtgatctaactgcgattactgaaaacaagaaacgagaggaaaactaatgggaataaaagctaaacaaactcaaaaggggcggggtttaaccgttgtcaaacaagcattagataaccgcaaaccaattccaatctactttgctttaccttataaagatattttgaataaaaaggggcatccaattctattggcagatgatacgtatgctgacatgctgaatctacctggaaaagatttggatttcctaaatgcagagggtgataagagttctaacgccattatcgctgactttcaccagttgttatcagtttatgttgaggacttcgatatttttgtgagtcaactacccgctgacacacgtattcagcaagcatcatggggacaagagttagtcagagtggaaaaccaattaaatagtggtgatctagatgatcgacactaccaacaattgctgatgatgcgccaaactattttgcaagaaattaacattgaaaagaatgtggtcggtgatataaagcatcaagaatacaccgctgtgatctatggcaaaactttagctgccttagataaaaaccgtcgtgactttatggcacacgcaggcatggcgtttacacctgagccagtctcaattaatcgtaaaaagatggtcatgtatcaaattaataatcctggggaaaccttagaattggaggaaaaataaacatgcgcataagtttaaataccgcaaaacgttccgctttaaaggcacgcggctataatttagaactcattgaggaagtacaaaatcctggtggcattgaatttcatactacttactttgatgatggtatggcaagtagtgccatcatcaatgtctatgactatcccaaaaatgaacaattacaagggtggtttaaagagttaatcaatcataaaaatacaattgtagacattaaaattgggactgaaaacaagtttgaggtgcaaaaagcccttgaaacagccacgaataccttgcgtagtaaggcccgcagtgaagtgacctcgcaaggtgacgcgttggaagcggaacaagatgctgacattacactccaagacttgaatgaagcccgcaatggtcgtgaaatctacaaacgggtttatgtccgtctattagtgagtgacgtctctccagaagaattacgccgccgtgtcaaagaaatccaacaacagctttctaactaccgcatgaaagtctatccttctgagcaattgacacacttccaacagttctttatgcccgccatgtcaattgaaaatcaaacgattaaggacaagggttttccaatgaaagcctatgctttagctggttcttatgcctttaaccaaacttttattgcacatcctcgtggttcatacatgggcttaacgatgcaacgtggtgaggttatgtttgatcctagctacaatgaccaccgtacgcagttaaccgcttataacctagtcgtgggtggtgagcgctcaggtaaaagctcgtttgccaaaaagaacttggggccattagtttctcgtggtgatacagtttgggtatttgataagtctaatgaatggcgtgatctagtgaattattattacggtgttactttgacacttgatggcagtcaaaacatcattaatttgatgcaagtgtttggcactgtcctagatgccaatggcaatgttgatgtcattgcaagtttcaaccagcatcgtacaaaagtgattacctattacgcaacacttaatccacaagccgacaagaaagaattagaaatgttgggtaacctgatcactgatttctacgttgaacgtcgtatgtggtcattatcaccaaaagataacccacaagatctacgcgtgattgggctacgaaatgaagactatccaattcttgaagattttcaaaccttcctagaaacccgcaacatgctgacgcgcaacatgacacaacctgccgtagaacgtttagataatattttatcaacgattagcagcctaattcaaaaccacggtgacatggtgaatggtgtgactaccatgcctgatttgtctggtgagcgtttgattcgctttgatactagtggtctttcaagattagaggatgatctatacaacgcgcaatactttactattttgtctttgatggaaagctacatcacgattaatggcacacaacaacgtgaacgcattaaacgtggtgaggtctccactcaagccaacaacaatggtaatccaccgaaatacttctggtggatacaggatgaggcggatgatattttcaacgctaaacactcattaggcattaccttcggtgacaatatgatggcacaacatggtaaagatttcttcggtatgtttgccattttcccaggtctaaaaaacgttgtcccaacgggcaatgcctcagatactgaggctagccgtgccgcatcttcattctttggccgattcccaaagcaaacgattgggcggctatccaaaactgataccacacgcttacgcagtgttgtgagtgaaactaatatcactgatggtcaactacaagcgctacaaggactggatcaaggtgatttcttaatgaacttggtgggtaagcaagctacgttcatgcacgttgatctcaatgactcagaaattaatttatttggtggagggctgtaagatgaaattgccacatccattaaagaaggcgtgtgataaccgcgaaaaaatgaaacaagaggcgcaacaaattgttgaaaactacgacaaaggtcaaaagcctcaaccagtggataataaaattatttggtatgtcattggtggttttgtttttgtttttattctcaaaggcctcagccttttaatcggaggttaaaccatgttagaacgttggatgcaagagaaaaaacgccgtttgtatgtcatcatcggcatcattactaccgctattctgtcaatatcagttattgccttaatgtgtgtcatggtcttttcaacacagaatgccaattgttggaatgatgatacaacaattgatgatggtggcacttcaatcggtggcgattggaaagatcccaactcagcaacgcacaaagccatgcaacatgcaattgatcgctttcataaagaaattaaaatgtcagaagacaatatcgctgctgcgattgcaattggtcttagagaaagtggctttaatccgaaagccgtcaatcctgctggatcagtaaaaggcatttggcagtggggtgctggaggtattaacggaaatcgctatggtgacacagctgatacagtgcaagcacaagttcaactggcaatcaatgaattgcatagtagtcataaagcaactctaattggcttagcggccgctaacaacattaacagttcaatggtagcttgggatacaaagtttgaaggggtcggagaaaatgatccacaacgaaaagtcgccgacaccacaaaaactgccgaagaagtcaaaaaggttttcaaactagactatgcaggcgatattaatgtctttgacagtggcaataatgactctggttcaagtgacacctcaagcgatgcccattcaagtgctatgtctgatgcctcctgtgacactgggttggataccaataccgatggtttaccggttaaaggtaaatacaatattacgggtggctatccaaactatgcagggctaacgggtgcagaacattatggtgttgattttcaaaccgttaaccacacgatgactggtggagaaagtaatgtctatgccgttcatgatggcacggttgtggctaagagttttgatagtgttggcggtaactgggttgtcatcaaaggcactgatggtgtcttcacttattatggtcatgcgcctactcagtcagccattgttgtcaatacaggtgataaagtctctgctggtcaacacattagtcatgaaggacaaactggtgaggcaacaggtattcacgttcacttcgctgtgcaaacaaaagaccaatataattgggcgcctgaaagtaaagggttgaagtcaccagggctatatctcaagttacccgcaaaggcaggcactaacgttgttattcctagtgggccatttgattctagtacaggaaaatcagataaataggagtatttaaacatgagtaatttaaagaaatggggcatcgcagtgttctctttagccgtcattgcgatattgactgcaattggtgggacttattactacaacacggaagtgaatggttatccagataccaagaacttcgctgacaagattgaccagttagatgccagtagcaagcgaaagacagtcttaattttccataagcctggttgccctgactgtaagcaagcgcgtagcacaatcaaaaagggcataaagacgcatcaaaaatcaattgattatgttgtcatcaatgttaaaaaatctgatgcacaaacttacttagccaagtatggtgtgacacaagtgccaacagtgattgccttaaaaggtaatcaagtgattgacagtaccagttcaaccaacaacaaaaccattgccaaagtggttgcaggagaataaccatgacaaagttcaatttaaaatgggtttacgcgtttgtgttaacgcttgcttgcctgtttttagtccagcaagaacttagctatcaacgcacggtcaagagtgtgaatatcgtgcatcaagaaatcaaaacaacaaaatctaagacaagtcagtacgttggccaggctaaacaacttgataaggttaaaaccgctgatattcgagatacccaaaacattcaaaaaattggcaatacttttctcaaagaaatgtttgccatcctaccaaagttaaataaatcagatgctaaaagcagcgtagcgactgataaagtggtgtcagcttttctaggggcaacgtttggcggtgatgtggatgaaggggtgccaacttttcatttagagagtaatgatattgtctattcaaaagcagccgatggctcaggtctaggatttgggacggttaaatataaattaggcaaagaggaaaccagcacaacactattgatgcacattgaaaatggcaaaattacagaactccaaacgggagctgtaaaagatacctcaggaaggaaataaccatgtcaaaagtaaataaaaaaatagccttattgtgggctattccagtgttgatggtggttgctggacttggcttttggttagctactcaagtcgctgttaaaacgcatcaaagtgccacaaacgaactagccgtgcaacaaagcaaactcatcaacacaaaagtaaaagttggcacggtattgtattcaaagcaacccaatgtgtcggcagccacaaacatgctggataaactattcaccctagattggacaattgcatctcaaaaggaatttgatgcaaaagcaaaacagatgacaccttatgtcactcaggatgtcgccaaaaatagtttagacttcaaggctgatcccgataaaatgattacacagacaggtgtggtaatgacctatgatcacatggatttcttacccacctcagcaagtgccacagaagtgaaggggaaggtgattgtctttgtcaaaagccacctcaaggactcggcagatgccaccacacgatttgtctataatgtcagctacagtcctaaaaccaatcttgtgacacaattagatcggattgggacttatcaattacaaagtgatagtagcgtgctataaactagataaaaattgaaaagatcaattaaaaattaatctgcgtacaaagatacttatggcatagttataaattgacaatgatggattaaacgtttagacttctcttataattaataagtcaaaggagaagaaatgcataagaatgattcacgttcacttttaattcgcctttgtttatctgttgttggtacaagtataattgcactagggattgtattctttcgcttatctagtttaggaattgacccagcaacagccgctgatattggtatatcagatacttttcattggtatttaggaaactatcaactaatctttaacttgattttatttctgactatttgcatttttgatcgcagtcaatttggaattggcactttaattaatatgtcattgccaggatacattgttggctatcttacgccaatattgagtagggtaatttttcacgtgttgagtaagaattctatcccagatattactattttatttgtttgtggcatggctattttttcattaggcattagtttatacacaagtgtcaatttaggggtttctccgtacgatgctgttgcacttttatttgaaaaaaaagggtggtttagttatcgaataactaggtctatacaagacgtgcttttctttacattagcacttgtatttggtggaccattgggaattggaacattcattatagcattcacgacaggatatatcgtacaaagttggcgtttctttttcaaaaatatttttgtcaaatatgactagttccaatccaaaaatataattcaagcatgaaatggtatgaaaaaaaccttaaccagaaatttccattggttaaggtttttagattgtttttccaacatagaaacgtttgttgatttcatagaaatcaaatgtttctaaatcattgttttcgagatgatgaattgctccttgagccggcatcagattaattggatacggtagattgcaagaattaaccgaacactgcgaactgctgaaaaacctttcgtggtgattgccaattgagtattttcattggtcttgcattaatccaatgattaatttgatcaaattctttggcgctaactgtttcaattttgcgctcctttggaataaatcgccgaacgtatcggtttaatatctcattactccctcgttcctctggtgaatatgggtgcacaaaatatactggaatgcctagttcctgttcgatttcatcatattttgcaaactctcgtccacggtcaaccgtgattgacttggcattcttgatcccttgaaaaaaatgaatcaaggctggtgtcactgcctgactattgcgcccagtaacgtgtctcacaatatgttgccggcttagtctttcagtaatggtcaccaacacgtcgccacgttgcttacctgattgcatcgtatcgacttcaaagtgaccaaaggtttgtcgtctttgaacacttttgggtctcgtttcaatcgaacgaccatgaacaaatacttgtcgtctaccatcagattgacgcttttggcggatacctttgtcaggtaaatcagtcactgatagcttgagtcgaccagcattgagccaattataaatggttttgaaaggtaaccctaaaacatgagcagccgtttctggtgaccactttaaaataccaatgtgctcattcaaaaaggcagcgatagctggtgttagtgtgtgatgacgaccacgtaaatgccgttttttcaatgccaacacatgagcaatatcagctttatagggcgtgacttgatgaatttcaacagagaccgtcgcaggcgatcggttaataaagcgcgcaatggcacgaaccgaataatttaattccagcaaagtttgaatgacagtgcgttcttgagatgataaactagaagacataagctgcagatcctttatggttgattttagtcaattaccattaaaggcgctgcagcttttttattcaagtgttcggtttaattttacaatctaccatactcaaaagtatcaccgactgttaatacaacaacaggtttatgagttgcgtaagcgtatcccatttcccagattgtaccagtatcttgatcttttgcatcaagtaaagcaacaacaatgtcggcattgtctatcgcattaacatcatcatcaaaagtggcagtagcccattcctgatcaggattgaattcaccatctacaatcggatttgatccttggtactggtgaagtaagggcacatgaacatgagctacggtcgtatttttgattaaggagctgaaagaatctttcaaaattttttcttgaagtggattaaaccaacctccggctaaatagattgttttaccttcatggtgttcagctgtttcagctatgtcgtgtaattcattaatcagtgtcatatgaaccatttcctcttattttttaactctaagaaatgataacaaataataacaattctgataatatttttctgctacacaatctcattttgcgttgaatgaatgataatcaagatacaataaattctcgttataatattttttcccgtcaaaaagggaattaggctcttcaccatagcagcggaaccccaatttgcaatacaaattctgtgcattattattttctgtcaaacatgttaatttgattatctttaaattcggtaatgtgaatgccttacgaattaaaagactcagcagactgtaagttaatccttgattgcgatattcttttagacacattaccgaggtaatttcacctttgtgagtttctttcagctcggtctgccttttaaaaacggcaacatttattagctttgtgccatcatagaagcccataacaaaatgtgtagatgaaaatttgactttatttttaaagtaatcatcagacttcatagcttcttcttcgtaagtagatccaaaataaagtggatcactttgtaaagctttcagtcgaatttctttgtacaataaataatccttttcacttaatactaagcacttcattttttggcctccagtttttgaaaaaagatgctaatgtgcatctacaaaaataaaataaattaatttttttacagtgttataattgaaaaaaatattataaaaaattatacaacaaaaagagaagaatgtttctaaatgaataagttactacttactgcttatggattttcaacgccaaaaattatagatgttgctcaaaaaatgatacaggaaaataaaataacaaaggcttgtattatttccacatcttggccaaaagaaaaagaaaagcaccctcagatgcaacaaattaaaaaagatctcctcagtatgaatatacagcaagtagatttcttagatgtggaattcgaggatgcttacaagctctttgattacgaccttatttttttgaacggtggctatccattctaccttttgcattttatcaaaaaaagtggtgctgatctaattttgaagaaaataaaccaaggtggaggacttatattcggtttaagtgccggttccattgttttaggcccttccatagctctgatgcagtacctttatccagaagataatcagtttaatgacacgaatttagatggccttaatttaacagctattcatgtctatccacactttaaagaaatgctaacccgcgatcctaaaataaaagataaaattgataaatatgaaactgaaaccggaattaacattaccagacttaataacaatcaagccgtggcacttaataatgacactcaaacttttttggattgagtgtcattaaattatttattgtaaattaactaaagcccatcaaattggatgggcttttttgtttgcctcaggaaaaaccatttacctttatgacaattttttgattcttgttattctgtgcgtgtgttgataacacaacaaagaaaaaggaggactttttgaatgaaaaagtcaaatgcacataacaagtttctatgggagcgtcgtccgatttcacgcttacaacaaacattagcgggattggttgcttcattaccaatgtggctaccgactgttgcctcagcggacattggtgatgctgccaaaacaagtggttcaaaggtcatcacaattctttatattgtgttgatcgttgttggcgctgttgccttactttgggcgtttatcttgcgttcaacaggtaatgaacaaatggctcaaaaaagtaatagtaagcttatgcacgccttatttggtattggtggtggtgccctaactggattattgctgacatggatttggcaaacagccacaactgctggtggcggaaacgtcatcaactggccattctagacgggggaataagaaatgtttggaaagaaaaaacaaactagtatcggtgatcccttttttgcccgcgttgaacaatccgagattgatttcaatgatgaggtgattcaagacttagccgaaaaaagtggtgtgagtgaaagctggccaaatgtatcactggctggactacaacaattcgctgcgggtttagtcaatgatgtggtgcgtgcaggtgatcatgacgttcgtttaggcaatatcgtttactttatcactaacgaaaaaggtcgtgctgagccaacaggtttaagttgggaaagggcgactctaacagcggggtttgaaaacattgttgttagtaccgctgatcatattttcaacgacacagaaattcgtcaagatgaagacatgacttatgacattatcgttgaagccttacaaccgctgatggatgcggtcattgcagatggcactctatcatcagatgacttgccagacttaccttctgaggatcagtttagacaagcccgtgaaacaggtgaagtcctgacagttgagccaaataagttccaacgcgcaacgattaaagtcaaaccaccaatcattgaagctgataaagctgaatcaaaagagcagctaaatgatgtgacggcacccaatgtttctaaggtagctgaacagccaaagcagccttcaagtgctgaaccagtaaaaccaactgttcaagctgttgttccgactcaagacaactcagggggtgtcatgaccgaaagtgatcccacacaaaagttaattgatcgtgtcaacctggcaccaaatgcatttgaaatgagtgatgtccaacctgacttacctgcggaacacccagattatgtggttagccgtttgaacgcagacaaagccaaagcaaacgactttctgaacgacaccagcaatatttacacgcaaaagatacgcaaagcgatggctgacttgttgaagcaacaacaagcaaagactaaagcagcagttgaacagttacgtgacactaatgtttctgagacggttgatgcacaaatgaaagaagaacgggcgacagagtttgaaacccgttatgcgcaagcacatcaagctcgtgaaacaggttatcgcacggctgtggaagatgagaatgcgcgtcatgataatatcctcaaaacgctcaagagtgactttgtaagcgacttagaggctttgaaagtatctgttaatcaagagctggataactggtttatagaacgttctaaagacttgcaaagtaatcttcaagccacagtagacaatcaggtctcagaagtgacgtcacaagcgcaaacagagacgctaaccagtcttaaagctttgcgtgatgagttattagctcaaaacacacaatctttgctagacatgcatcaaaagctggaagaagacatcagtaacaagcgggcacaatatcaatcagagcatgaaaaagcaatgatcagtgcaactgagttagaaagtgctaaaacgcatgctggtaacctcagtgaacttgagcaacaagtccaaattttgaagcaaactaatctaaacctcgagcaacaattaaaaggtaaagatgctgtcaatagtgatgaggtttcccaacttcgtcaacagttacaaatgcttcaaaatgcccccaagacaacatcacatgatgaaactaatcaacaattgatgactttgttagcagcgcaaataaagcagcctcaagttgaacaaaagaaaacaagtgcttggcaatcagcggcgattggtgtcttggctgtactggctattggtggtgcgggctttggtggttatgcaatggcacaacacaaaacagatagcgccacacaatcatcaaaagcagtctatgcgagtagtcacaacgaaggcaacgcaaccgtaaccttagcacctgaatcatctgaggctggttcttcttcaaaggttagtgcttcaagtagtcaatcaagctcatctagctcatctagctcgcaagctaacagttcttctacattagctgaccgttaccatgtcggtgaagacgttgatgccacaatcaatggtcaaacagtcacagctaaagtcgtttcggtacaagacaaaaccattacagtgcatcatgatggctacgattatgttgtaccatttgacaattaggcggtgaactatggcaatcaacattgaacaagtcaagcgccgtcgagagatcgcgcaacccagacgtccaaatttccatcgtttgaaaaggcaccatccaattctaaagacactgttattagccatgattggcatcttaatcgtcacgggtgccgtaatttatggtaatcatacccagtggcaaacagctcaaagtgtccaaaaagctagtcacaaggcggttacgaaagccaaaaagcaacccgttgtcaaagccagtcaagtcaaacaagtggcggaacaaaaaagtgtcaaacctgattactcaggcactggcggcttgtctagcaaagaagatatgttaaagctagcgcaaagcaatcaagccgaaattctacgtggtcatgtggcagtgcctagttttagcattagtgagccaatctatgaaggcacaagtaaccacgtcttagccattggtgcgggtatgaatgcgcccaatctaaagtttggcactggcttagtgccaatatttgcgcacaatatgggtgattataacgccgtgtggccataccatccaaccaagtttagtgcgctacaaaacatgactgaaaaatccatcatcgggaaagatatttacctctcagatggccatacagtttaccgttataaagcgaccaaattggattatggtatcgctgtgggtgtgatgaatcaagaattagctgttgagaacacaggccaaccaagggttaaattgattgcttgtttggaagatcaggaattttggcagcaggttaaagcgagtcactacacaaatttcaccgctaaaaagcgaatcgtgctcacgggtgaattagttggtgaacaatcaatcaattccctggaaagtaatttaaagcaacaattgcaataaaacttattaaatagtaagggtggcaaatcaccaccctccaaacatcggaagagagaatatttagtatgtcacataacattaagcacaaactacgccgtcgtatttttgaaggcgctgccattgcaacgattatgattccaatggcttcaccaatcattgcacatgccacagatacaccaacgccagttaaggtatcgacgactggtacaaaagtgaaaattgatgacggggctttgcaaaaagctatcgctgatgctaaagctgctggagtagatctaacgcaagaaaagacggatacacaaacagttaaatctagcgaagtcacatccgcaaaaacaaaaatcactgatggttacaagacacaggtttcaacgcttgaagctgctactaaaaagcagaccaccgctaacactgactacgctaccaaagaggcgcaatatcaaaaagatttagctcagtataacaaagatgaagccgcctatgaggcagaaattgctaaacataaagatgatacgcctatcgctgacaagaatggcatcaaggtttatggtgattataatgaagctggtaaaggctcactagattactacaaaaactttgatgttgtcgttgatggttcaaaggtcaaagactttgcgtctgtgtctgatttgggttggaacaaagaaagtaaggtcactgcaattggtaaaacacaagttttgaatactgacagcacaaactttaatgccccttcaaaggatatgtacctaattaaggatttcaataagggacaacagttcaagattgaaaatgttgggactgataagattacaggtaaaaaaatcaacgcgatcattacctttaccaatactgttaaaagtaccagctctgattcgcattacttagctgttggtaagcaagatatggatggtcaaactaatgattctgtccgttttgaatatctgaatactgatggggtcaagactaagattaactatgaatactctgatggtaaagcggccaatttggtcactgccttcgccattggtgacgtggatgtcttacaaggtatgcagaccgattacgtcaatgttacccaattgagtccaaaagacaatggcctagaaatcgacaaggatgcactttctggattatttggaacatatacgaccagtgctgctggattggatgggtttaacgacacaccactgggaacagttggtttggtaggcactggttcaagcttcacgtttaacttctttgatgaatatactaagaatgctactaaagaagacacgactgcaagcaatgtcatcaccgaaaagggtggtttggttaatgcctggaaggctttgggaacacaatacaacctatttggttcctctgcggctctaaatgtcgtgacaccacccgttaagccaacaccaccaacaaaagaaattgtgaaggcaagttacaagctcagcgatttgtacacaacgccagagccacataagtcagaaacagatgatagtggtaaggacaacaatggtcaaaatgttaagttaggtgaaaccttgcattacaagttgacgtgggatttgaaaggccctgaagctattgacgtggacaaggataccttagctaagggcttgtcattcatggatgattacgatgagaccaagttagatattactgatcaaactaaaaaagatttcactgtcattgatgctaagacaaaaaagtcagtgatggatgaactccaacaggattgggaaattaagaatggtaaatggactttgaaagccaagaacgtacaagactttttgactaaccatgccggtcatgaattgaccatcacttttaatccagtggttaaaaaggatgccacagggactgtgacaaacacagcggttcaaaatgactttggtcaggattttgatactgaaacagtgaagaatccaatcacgccagatacatcaaagcctgatacaccagcaacaccaaatacaagttatggtgaagcgccaaagggttggttatatggggcgattgcagcgattgcactagcaggtgcagcctttggattccgcaagccaatcaagaagtggttccacaagtaacaatggttaacagtgccttagggcattgtttttttgttttgtctttatcaagccataaaataatgaacaatatatattgttttgttcttcacaaagtggtatatttaagaggttcggaagaggacttgacatgcaatatcagtagtttgctttcagaattatcacagttaactagcaagaaattatcatatcccacttcatataaatactgttgttgcatggcttttcaggacatttttcctaagttaaacatgagtcaatcagacctgatttactgcgcaaaaaaagccatccactgatggcttttttgtgtgcgattataaacaatcgcacttgtcaagatggatggacatagaaaattgactgctattaggtaaattaattaactcaatattatgagaaaataaaccaatgtttttatttaaaatctagtctattatcaatgttaatatcagtctaacggctaatatacacgtacgtataacacaaatatattcacgtatatactaaccactatatacgtaagtatatatgtgtatatatacaccatcatgttagccattatagtggtgttatatacacgaacatatataccttacatacatcttaaaaccttgctataacaatgtttgcgcagttgttcacttttgtttttcttaacattttaactattgaccgaatgtcaattttatagttttattgagagaaggaataattgccacatgactaaaaaaaatcccaaatccaaatacgcacgtttagagtttagtgagcgtatcacgatcaaaaatatgattgacgcgggtaaaagcaatgcggaaattgctcgaaaactaaaccgtcctcgagctaccattacacacgaattgcagcgtaatgcccgtgtcatgacttggcgtggcaaaaagaaaatattgcgccatacatacgaacctgtgcaggcggcaagacgtgctgagtattaccaatcaaagtcgcatcgttcacagcctaaaatcacacctaaaaaacgcgaaaaaatagattactatctcaaaaagaaacattggtcgccagaacaaattgcacatggtgtgccacgaattggtgtttgcacacgaacaatctataactggatacttaatcgcaacctgagtgcaaccttaaatgatttaccgcttaaaggcaaaaggcgcaggcatcttagggcaaaaccagttaatccagaacataaacggatgatgattgaaacacgttcaatacacaaccgtccagaagtcatcaataatcgctcaacatttggtcattgggaaattgatggggtgatgagtcctcaagattcccaatctttcgtgatcacatttgtggaacgaaaaacacgctttatggttggtgtcaaagctaaaagtaagagttcagatgatgtcaaaacagccattgatacctttatgtcaaggtttgagaatgtttgtgacagtataacatgtgatcgtggcacagaattcaccagtagtttatttatttacagcattgaagatacttacgggaaaaagttatattacgctgatccacaatcaccaggtcaacgaggtacaaacgaacgcatgaatcgtgaattaaggcgtgtatttcctgctggttatgactttactaagattacccaacgtaaacttcaaaatgccattcaggacatcaatgagcgtcctagaaatgtgctcaggttcaaaacacctgaaaaagtctttactaagcgaatcgtggcagcttaatcatcaatagatgctaaaaatcgctaattgttaagacagttcaaagtcaatagctttgggctgcgtttttgcgtataataataaccagataaacacgaattaagtgcttgattggcttaaaaaaagtcaaaatggcaaagcaaaaactaaaaatgcgaccaaaataaaaaataaattatggtaactaaactttagaattgtaaaaccaaaaatagcactaaaaaggtctttgtaaccagattgtaaataaatccgctatcgcaacagcgacaacgaattagcgtaattaaattcaatttttttagtttatttgttacttcggagtctgtagaataataagcataaggtttgatataggagttgaaatacttctgtaacacaccttgtgcttatatttttgtcaaaaaagcttatttcattaagaaaatctaaaaaaagcaaaaaagcaaaaaaaaagaccagccaacggctagtcatttgtacattgaaaattgaatatactcttgattgataaaataatgccttcgacaacgttattaacaagaatcaaaaattaaagttattttcaatagtttaattttatacgattatcattcatcaatcaagcgcaggtacagagagaaaagtctgatactgcgttaaaaaaaatcgccgtgccgatgagatgtaaacttgtaatgggccataagtttacctaaggtttggcgtcatttgaaaatctacttatgagaaattaattatttacagaaaaattaatcataacagtttgtttttaaatgttcctaagtcaaaaattgaaacgtcaatattcttttatgaaaatcaaagagtggacaattttgctcaaaaaaatctagctttattaaacaattctctaaaatctaactaaattgtgatatgatttagttaaaataattagaaaagagtgtgcaacgtgattcgtccagttaacttattgtctattactgctattcagaatgaaccagtaaggaaaaaatacttggaatatattggttctgaggaaaggcataaagatgaattacctgaactattaaactttgccagattattaaattcccacaatttaacaacagacaagttttacacattttataacattccacaaattggtaaggagtttgatttattagcctttaatgctaataatgatattatcaacatagaattaaagaattacccaagtttctctaaagataaaataaaaaaacaactactgagaaataaatattatcttaattcagtgtctaataacgttaaactatatacatttaacagcgcaacaaacgaaatttattttttattagatgatgatactctgcaagtagacttagttgataactcgtctatgtttccaaaatcagcattatataaaaatctcaaaaattttgagaacgtagaattagaaagtatagattctcttttcgtaccatcaaaatttttggtttctcctttcaatgatggggataggtttttaaatggtgattattttttaactaatgagcaagagacgattaaaaaaattattttgaagggtaattttggaatgtatggaataccggctccggctggtactggtaaaacccttttagtttacgacattgctaaacaattcataaaagatgggaaaaaagtatgtatagttcatgtcggtcagcttaacaaaggtcatttagaattgtctcatcaccctggttgggaaatagtaagtatcaaagattttttacccagtcgattttcatctttcgattccgttatttttgatgaaatacaacatgctaacaagcataaaataattagtatacttgatgagttgagaaattttggtatagacactattttagctggtgatccaaagcaagtaattgataatcaagatattggtaaagaatatatatcatatattgaaacaaattatgataaaaaaaatgtaaagagcctttctcgaagaataaggactaacaaacctgttgctagttttataaaacggttatttaattcgaaagatacggctggttctgaaaacattttgtacgatcatataagtttagcttattttgacaacgaaaatgaagcagttgaatatgccaaaactttaataccagaatggaatgttttgaattatacaacgtcaagatttgatcctgaatataatgacgtttttatgtcaaagtcgtttttaaatcaacacaaagctatcggtcaggaatttgacaatgtagcaatattcatgggcagtgactactattatgagcatgatcatttaaaagttcacatagataaggacagtcattatccgaccagaatgggattatttgaaaatgtaactcgtacacgaacgaatcttaaaatcattatatgtaacaacgaagagctgttgagtaattgtataagcattatcgaataatagtaaataaaatagttaattcaacgtccatatttttcatacttttaagttttctgagaagtcaattaaacagtatttttattcagttagtttggttaaattttaaatgagcttgcgattaaaaaatttaacatacatgctaaaaacctaatttgccaatattaagaatgctaagtaggctttatgtaatacatttacttatgtgaaattgcaaaaatcactacaatatttttggaaataaatatgatcacaaaaacgtcttttatagacgtttttattttaaaaaaattattatataggagaaataaataatggttaataagtttggtagtttatcactacaaggaaaaagtataggaaagctcacatttgctgggcgaaatttagttggtgctaatgctgatgtggcagtggcaatgttgaatgtgaataatacattgaatactgaaaacgtcacaccacaggctggctttgattttagtatagcttttggcacaccactaaaactgatcgatgcaaaaattattgctggtactgctcgcagtaaccaaagaaatggcgctcgtgttgccactaagactggtactttgttacctatgtctgatgctatgacagataccttgccagaagaagaatatgatgctgtatttgtatcaggcaaagacaaaacaccacacggacgtgtgcgcagtgctgatgcgtttgatagtcatgatttagttttgtttagggttacacctaattataaaaccgacaatcgtggcgaagtggtacgtgatgattacgatgagccaatgatttctaattatcaatttaactttatccaacaaagtaaatcaggcgatgttggcaatgatgataacattgtccgtattttggttgacccagcagaaagtgaacgcttgcaagctggtttgaagccaggggacaagttagtgccacaaggtttgaaatttgcgtttgctggtaatgatgccactgattggacggtgtatgctgacacgttagttgtccttgatgaaaaggcaaccgaaaagccagcatcaaatcaaaacaagtcaactactaatcaagccgacaaagcaaaaggttaatagggcatttatatagaggaattatacattaaattcgtataaatggatgggtatgagcgaattattttatcctcactttcattgtcagaaaggtctctaatcgggtgtgatttataagtgcttcacatctaaaaaaatgcgaaattgttttggtaacaagttaatttacattaaagaaattaataatagaaaaatgatgcaatattttttgtattgtgcaataatactggttgagttaaaaataaacagtattggaagttataaaaatgttaaaagaaaatcagtcaaagtggtcttcggctggtgcgctaattgcaataggcatagtattcggtgatattggaacttcgccattatatacaatgaattctatcttgaatagtgcaaaaagcgcccataatcttgacacttttgttattggttctgtttcattagtattttggactttaatgttaattactactattaagtacgttatcatagctttgcaagctgacaaccatggtgagggcggtatctttgctctatacagcagagttaaaaaacctaataaaaaatggctattattaccagctttaattggtggggcagctttgttagctgatggtacattgactccagcagttacagtgactacagctatagagggtttaaaagggcaagggataggcgaatttattttcccaaataatcaaaccatagttttgtttgtagtaactgtgattctattaattgtcttcacatttcaaaaagccggtacaaaaaaaatcggaaaaatttttggacccgtcatgcttatttggttcttgtttattggtttctttggtctagttaacatctttagtgatctatcaatccttaaagctctgtccccaacatatgccattgctgttctatttagtcctgagaacaagactggaatttttattttaggaagcgtttttttggcaactactggtgctgaagcgctatactccgatatgggtcatgttggtaagcataacatttatgttagttggatttttgtctacaccatgctaatcctgaactatatgggacagggtgcctggattatgtctcatgctaatcaagaaaatctgttgatgcaatcgtctaatccatttttcgagattttacccagtggatggcggatttttggagtggtaatggctgctttagcagcaatcatcgcttctcaagctcttatttctggggcgtacactttagtcagtgaggcaattaatttaaaggtcattccccgtctgcggactttttacccaagtgatgcaagggggcaaatgtacattggcaccgttaactggttactttgtgttataggtttaatcattgtatggacattccagacctctcataatatggaagctgcttatggactatctattacaatcacaatgcttatgacaacgttgttactgtatcaatttattaagcaagaaatgaaaaataaaattttggctttcttttttgtggtaatatttggattgatcgaaaccgtatttttgatagcaagtcttggtaaatttttacatggtggttatgcaacattgattataatggttgctattttaagcgttatgatgatctggttttatggtaataaacgtcgtgaggcaatatctcaacaaaatgattatctttctttaaaagattacagaaaacaacttattaatttgtcgaaagataatgaagagccaatctttgcttcgaatctagtttatattgtaaatattcatcaaaactacatgctaaaaagaaacatcatatactctattctaggctccaaacctaaaagagctgaaacatactggtttgttactatgcgctcatcaaacgatccgtatgaaaaaagctattcagtcgatatgttgggcactaacaatatcgtacatgttacattgaatgttggatttaaagttgaaccacaaattaacgtgtacatgaaacaaattgccaataatcttgttaagcaaaatattataaaaccacagtttccaaaatatacgctgaataagcgagggactgttggagaatttaagtatattatggcgagtcaaaattatgaagatttacttaatctaccagacattcatacttgggaccgttttattatatctggtagattatggctgcaatcacacactgtaaaaccaagtagtttttatgggttagaagtgagtgatgtactggaagaaacagtaccattatttattaaagattcaaacaaaagtaaaattaaacttactcaaaacgagattaaaaatgtcattaaagctgaataaaagtagaatcaaactttattaatttgatttagtgaatgggctgacagaatttctgttcagtaaatttaaaatttagtagaaaggttaaaggctgattcaacaatcggtcttttttggttgtgacaatggcacagaaattactttattttagctttatgtttggggtttggctcgtatacgttgggtctatgttccctatatttttgctctttatgagtttgagtcaatcactgcatgtcgctatgataattgctagtgtgctgacctttttatttattatcgttcaacgaacctttaaaggtttacatttaatcaaccaattacaaaagaatatttgagagaaaggataggttacttaatcagtagccttttttattaaaaaattatgcaaaattcaaaaaagtataaattatacaaatctggtaagctctgggttgtcggggcatttgcagtagctggtgttgctgttactgctaataccacacaagtcagtgctgatacggtttcaaatgctgatgcacaagctgttcaaacgactgatgccacgcaaagtgacaagcaagtgcaattaactgcttcatcaactgatacagctacggacaaggcgacaactgatgatgccactaaaactgcaactgtttcatcaactgctgaaaaaagcacagtaccaactactgctggtactagtgttacacaagaccaagcaaaagatgcagtcgatacggcacaagatactgttaagagtgatgcagacactgcttcaaaggctgacgttgatgtgacgactggtaagacaactgatgtcacaatcaatgatgacaatgcttcatcaaaaacagatgaagtgctatctgatttgaataagcaagatcaagcggttaaagatgccacggcaaaacaacaggaaaatgatgaagcctatgataaggcaactactgaaaaagatgatgccactaagcaaggacaagcagatttagaccaggcaacgtcagaccttgataagcaagttgatactagtgaaaaggctggtatcaaagtcaacgttgaagttgcacaatcgtcacccgaatataaagacttgtctggtttagagggtcaagatttattagatgcaatggcttataacataaacttgtataagcaagcaatcgcagacggtgtggcaagtgaaaaagctgatactgaaacattggctaaattgacggctgaataccaacaaaagcaagctgattacgccaaagctaatgcagaccgtgatgaagcggttgaaaaaggacaatcagatttgaacaatgccacatcagaccttgataagcaagttgaagcaagcaaaaatgcagggcttgatgtgagcgttgaagtctcaaaggtttcgccaaagtacaaagatttgactggcttagagggtcaagatttattagatgcaatggcttataaccttgatttgtataacaaagcagtagttagtggtgtgtcaactgaaaaagccgatactgaaactttggctaaattgacggctgaatatcaaaagcaagtggctgactatgaagcacaaaaggcagcggttgataaggcaaacgctgataaaaaagcagcctatgaaaaagcacttgaagattatatgaatgggactaaccatacgacaagtatgacagcccaaacgcaaactgatgcttcatctggccaatatcaaacctttatgaatgccactgttgaccaaacaacaggtgagtttacgctggaacacgatatgaacgacggtgtacacatcattggtcatggtgttttgaaaggtaaagtcaattggaagattgtttcaaatggtgacggtacagaaacagttacgatttcatcaatcgaactgtattcatatacttatactaatgcttatcaaaaccaagccgttaaccaaaacattaacttccacgtttacgacaatgacggtaacgaactattttcggtttaccatgacggcaatacgacattctcaaagacaatcaataagactgcacaaattaacaagactttcaaaatttcaccaaatgagacaagtcctttagcacaggtattggttgttgatgataactggatttggaatacacacggtcagtatcaacgcaaattaagaatactaacgtagcaccaaaggcaccaacttatgaaaaggatccagtgaagcctacggcaccaaaagcaacggttcatcatgtacaagttgtggcacctgaaaagggacaagaacctgctgtaccagttgccagtgttaaaaaggtaacggttgcggatatgccgaatgctgataagccacaaccacaaaaggttgaggttcattattacaacattaagaagacaccaaaggtcgaaaggacaactacacctgaaacaccaaaggcagttgagacggcaagtattttgccaacaacacatgctaatgaaaatcagggcggtgtttggttgagtgtattgacagggttagccagtcttggtttggcttttggtatctcaaagaagaataagaagcaaaactaattagattaactgctgctagtgacgttatcacagaatataaccaaatggggtgtgaagcccaaagatgttaaaggggaacagttatgtcatttagtgataatcgagaagtgaagaaacgtatcaattatttacaatcgcagttagatttagttgatatggctgttcaatcgttacctatcttggtagcgaatgttgaaaatcatcaaacaatagcgcaatgtgatgaagcaattagtaatttcaaaattgatttacagaaattgtatcgtgatttgtctttgtttaaagatattgaattttaagaaatggaagtataaaaaatgcaaaaacagcttttgattgcaggttcagtattgggcgctttggcattatgtcatcaagcagttagcgctgatactgtaacaaccacaactgatactagtacgtcacaatcagttcaagcaacgaccaaggctttaccacaagttaaggcagttgtgttaagtgctaatactgatgttgtgagtgattccagttcaaccgtagatgacggtacgaccgttgacaatggtgggacatcaactgataacggtggtagttcttcatcatctgataatggcggttcaagttcatcaagtgacaacggtggcagttcttcgtctgacaatggtggttcatcatcaagtaacaatggtggcggttcttcatcaactgatgacggtacgaccgttgataatggtggtagttcttcatcatcagacaatggcggttcaagctcatcaagtgataacggtggcagttcttcatcatctgataatggtggttcaagctcatcaagtgataacaatggttcatcatcaaatggtggcggtacggatagttcaacgactggtggcaatgggtcatcaagcgacaataatacagtgccattaacaccaacaacacctgatacaaacaatcaaggtgaagtcaaccatgttaagccagttgaagtaacacctgataattcaggaaacgttgttgatgtgccaacagaagttgctagtgtacctagtgttgctcgtgcagttgaagcctataatcaagcactaactgctaaagacaaagatgcgacaaaagcaccagttgttgaagcaaagcaaaaacttgatgatgctgtggctaaagcattgccattaacacatgccacagaaaagtcatcaatggctggtaatggcatcttagcattggcaatgtctggcttagtagctttgggtggtttgatttacaagcgtaagcaaatttaataatgtgatgcaaaaatagcgaaagggggtgtgaaatgcgtggtctcccaaaactcaaagtgaactttgagtatgaaaagaaacaaaaagaaaaagcggtaaaaattccaaaagcacatgtttataatttgagcaaagtacgtaaaattgttgttggtctattgattatcttagtgctttattttgcttatgttttagttctagccaatggtgtagctattaaaaaccgtgaattaaggcataacattactaatctcacaactagacttgataaagcgagtgctggaacaaccagttataacccaattgtggggcaatacttggcaaactttgtaaccgcttattatacatttgataaaactaaatctgatgattggttagataaggttacaccttattttgctaagaatatcacgttatcatcatcaactaataccgaagatatggagctattacaagctaaattgaacggtatttttactgtggatagtattaaaacggcacaatacaatcttacgattgataatgagggtaagcaaaatgctttgactgtcaatgtgccttatacacaagataatgataaattgactgtgattggtttaccttatgtggctaatgagattgatagtgttggtcaagtgggtaaagctagatttgataagactggtaaaacaatcaatgacgaagcgatcacggcaaaggttcaaaagtttaccaaacaattcgtgcaaaaatatgtctctagttcaactaaagatatgtcgttgttcatgaataaccctgtgggattagataatgcagtagatttggttagtcttgatgagagtgatattaaggtgactggttcagcagataagccaattgtcactactaaaatcacagttaaagtacatggttcagatatcacacaagtgcagacaatttacttagagcttaaaaaacaaaattcaacgtattttgtcacaaagtttttacaagcttagaaagggggtatcagattggacttttataattcaattaaacctttattgttagttggtacagttgttattgctggtggacgtgcgttgatgcattatggcaaaaatgaatctaaagacatgtggatgtcaatatttattggtgctttagtttatttcttcgtcaatggaccgcaaaacagtttacaagcatttagtggtattttgaatgctttgttaaattgggtcaaaggtattggtggttaagatgtttaattatcgacgagtttatatcaattcagccaagtttagcaaaattggaaaaggtatgcgtttaccgattatggttgatacaaggtttttgtacttgttctcaatcatgttaatcatcacagcattcattagttatgtcttaggctggtttcacatgcagtatcttagtttagggtttgggttaatcatagtaggtgaagtagctgtttactatttagaccgtaagcttaaaagagataatctaccatttgaaacaacaatcagatatttagtgacttatgtttggcagttctggtttcggaaaaatcaattgtatcagggaaagcgtgttaatagtaattcaaagcagtacatgatactgtgagtaaaaaaatttaaagagcatggtcaaacatgcttttattaaggcatcgtcaatcaaacgataggacaagttggggcagtaccagcagatgcgtaaaatagttgaaaaagacaatgagaaaggtggtgtgttaaaatggacataacaaatcgagatgtgagagaaatagcaatgccaaaaaagccaaataaagaaaagttacttgacgaagtaaaagatgaaaagcctgttaagtcaaaaatattaactttgccaattctcattattggttttttagttattctttttggggcatacatgctctatgcgatgacacataagcatattacaagtaaaacagaaacatcaaccgttgttaaaacatcaagtagttcagaaaaatcatcatcgagtaccaaaaaatatgttgctggtaaagattacaaaatcacttatagtaacactaatttaattgatagatctactttagataaggctttaaaaaatagcactggtgcagatatatcctacatgatggatacttctgaagatggtggcgatatggcaaaggttgaagtttactataacaaagataaaaatttgttggttgaaaatctgttcaagaacggacattcgagtaatgaagccacaactgctgttgtatatgatttaaaaaataatcaaattgtcaatagtggcgtgaattatgacacgaattaccaaccgacatggctggtttatacatgggaaaaattaactaaataagtgatacaacaaacatttacaaaactgtaagtgtttttttgttgcacataagaaaggaaaatgatgaaaaaatcaattatattattgcttgtaattggttcaatgtttagctcactagttgttagtagctttttaatcgcgccacaacatgtttatgcgttaacgtatgattccaaagaaataaaagaagccaaacgagagtcagataaggaagcgttggcaaaggataaggcagacggtaaagcagttaatgaggggacaacccaacccacgcataccaaaaagacaattaatgacaaactaaaatataacgatattgattggataaataaaaatatttctaaaaatttcacagtttattatcaatcagggtcgttgactgatttagggctgagttcggcacatttagtcgctagtttgtttatgtcactcaatttatacattatctatccattgttcgatacagctttatcaaaaatgtttgatttaactaatatcacgcaagggatcaatgatattttttcaaacgtccaacaatttaccaagcaaacatgggctggcgaagtttttaaacaattattgtataccgcttttggtttagggctcgtttgggtatttattcaaagtgttaaaagtggtgctggtttgaaagccattttatcagttttgttagtagcgattatcggtagtgcttggataagcgctggtggtacagtcttgacgaaagttaatgaatttacgtcaactgcacaaacggctatgtttactgaaacgtctaatattaacggacaatttactgatagtggcgacaaatttgagagtgcaatcagaagagcttattttgaaaagtcggttattcgtccttatacattagctaactttggaacaaccaatttagatgccagtgaaaaagacgggtcgtatcgtctaatcggtggtaaagctgatagtgatgtgattgatgccctagcaaagtcaaatgattatctctcaaaagacggtggcgaagaatggtatcaagcatctgtcggacttatggcgccaattatgtcattagcttatggtgtaccattgttgatgattggggtatttaatttgatattgcagttaggggcaattttgctttactatctatcgccttttaccgtgttgttatcattgttaccacgtttttcaaacagtgctttaaaaactggtttaagtgcgttaggtttgttattcgcaaaaattgggttattatttggcatcatgtttgtctcatgggttggtacagtaactgatacgattgtaccagttacaggtagtgcgagtgcattgcttaattcaattgtgtatatcgttttaatggttttgctttggaaaaataaatcattcttagtgcaaacagttactggttcatcaatggcaaatcaggctttgaacaaaattcaactgacacaggcaggccaacgtgcgatgcaagcaagtagcgagatttttaattcatcaaaacacggtcttgaaaatatcaaaggctttagtggtcgtcatgccaaagacaaagacgagcacaaatctaaagataaagatgaagattatgatgaaaaccgtgatagacgtggaaatgcaccggatgagcaagaaatccgtgaattagaagaacaacgtagacaagaacgtgcgcaacgtttggctgatgaagcagaacgtcaacgtcaaagagatgctgatgaacaagatattgattataatactgatcgctctgctgatgaagattaccctgataggtatggtcatggcgatgatgatgaattgccaacatataagcgtacaccttatctcattcgtgacaaagccacagaagacaatcatggaaacggttctaatgagcctgataggtcatttaaccgtggtcgcgtattagatgatgaaagcagtgaaaaattagctgaaaagagacgtgaagcacgttcacaagttttgaagcatagctctaaaccagctacaccaaaatcagtatcagaagatgacgataaattgcaacatcgcaactttgatgaagccgttcatcatcaagaacaaatcacacaagatgaagaaaaagagttagataaggagttgtgatgcaaaaacaattagtgtctcatttcaaacgtaaaattttgttttttttagcgccttatttggctttcttcttagtgctgttacttattgtaatggcacttttctatcaggataataacaatgattgccaaactaatagtgaaacaaatgttagtgtcacaacaagtgctgataaagaagcggttgccaaatcaattcatgataatctcaaaaaaatatcaggtgtgactgaatctggtattgctggttatttaggtaatactgaaactgaaagtggttttaacgccagcatcgttcaatcaaatgccacattcaatgaaagtaccgctatgaatgctagtattagtggctacgctttagggcttaatcaatgggacaactcaagacgtgttgagttgttgaattatgcgaaagctcaaaataaaaaatggtctgatgcaggtttacagttagattttgcgcttaatcatgacggcacaaattccgatttgttaaagcaaggtttgaaaatgaccaatgttgatgatgccactgaatttttgagagcaaagtgggaacgtggtggtgtagggacaacttcaaaaagacaagcctatgctcgtgcttggtatgctaagttgtctggtggttcatcaaatactgctgttgatacggcaactaatggcacagaaaccacacaaaatactgataatacaaccaacaattcaaatggttgctcaactaatgttgcgcaaggtatgggaactagtggtgcgccggttaaagaaattcctagtgcttataaaagcaaaatcaaggacacaaatttcacagctacgtcatcatcaaacacttatccattcggacaatgtacttggtatacctataatcgtatgcaggaattaggcacaccagttgaaaatggtttaggtaatggtgctgattggggtaagaacgctaaagccaaaggttacaaaactgatagtcagccacatgttggttgggcggttagtttctcacaaggtgcagacggtgcagacacaacttacggacacgttgccgtagttgaagcgatcagtgatgacaaaacacatttcttagttagtgaatgtaatgttgtggcatctgggactggtactgtcagtttccgtgagttaacggctggtcaaggtgtgacctttattcaaggcaaataattgaaaggagaaacgatgaaaaatagtcgtttaatcatctttgctagtttagtgttggctggaattttactagtccaattcaatcaaatacctaacttggataaacaatttgcacaagcaaaagctgatttaaaacaaactaaattaagtcataaaaaatcagaaacaatcgtatcaagtccaaagtcacaacaaaataaagtatcaaatagtacaaaaaaagttacttcatttgttgaaacatttagtaatcagcctacttcaacttatcctgatactttgaaagggttggcttcacaaaaagtgattaacgaactaacccaaacttttgcgcctagtgtgacgtttagtgacaaggcacattatgatgtaccatttgtaggacttaaaaatgcttggaggtctgatttagaatatttggttattgctaagagtgatgcacaaagtgtggcttactcaattatttatgatactgatgaaaaacaagtcacagatatgtcacgattaaccttgaaaggggcattcgataatgaaaaataaggttttacttagcattatggttttgcttttgtttggtcttggcattatgatgtcaattactaatggtaaaagagtacaaattgaacaagttagaaaggaagtgtcgcaagtgactaaaactcaaaaacatgtgaccactcaaattgataacttaaaaaccacgtacaatgccaatgatgccaaagctaagagcaggttacttgaatttgcaaaagcctattatacttttaatagtcaatcagattatgataagcgatttagtaaggtgtctgatattttaaacctatcaagtgaacaaaaaaatcaactatttgatagtggactagatgccacaggttgttcacgtattgataatttgggtctaactagtcaataccaaacagccacaggttacacgagtgatttggataatcaaacaattgagagcctagcgactgtcgtggttaaaactagtggtacaggacaaaaagcaatcaatcaaactgtgctaatacacggctggtttgatataaaaacgcaaaaactaacatcaattaaaatcaatcaaatacagtaaggagaataaatgatgaagcactatattaaagggggtaatgacactaagaaaggcacaaaaaagcagttacccaaaccaattacaattattatcaataaagtattaccagtcattgtgttactagtggctggtttttattttctacctcatgcatcaatgaattttcaaaataacgatgttaagggactaaatacaagagcagaagccgtgatgttttacaattcaacttgttcacattgtcaaaaggtttatcctaaaattttttggcacaatattttaaactttaacaacgatgacaagcaaattcaaacaatcaacgtacaaaaccctaataacaaacattatgttagcgattttgcggtgcaagaaacaccaacgtttatgaagccaaataacccaaatatgaaattagtctcaactgatgtaaagaaaattaacaattttgcagagaccggcgcaaatgatcaatgaccaatattataagaaaggcgggtatttaagttatggcaaaaaaagcaacggtcaaatatgaaaaccctgttgtgcaatatcgagataatttattgctgacaacgattggtgatgtatgggcttattacaaaattaaaccgtttcaaatcaatgtcgccaatgttgaagataagcggaaatataagaacagttttattgatgtctttgaacgtttacaaaaatatgatgatgttgatttgaagttgattccaaaagatatggacttagcgggacgtattcaaggcacgagtgatgattgggctgatgatttaagggaagttgccgagtactatattggtcaagaagaagttaatctcttagagagtgagttcaacccagccattattgatgaattttatatcggggtcaagcttaaaaacatcaatgttggtgatgacttgaaagacaaggttagttttgtgactgatttagtcatgaaacgcattgccgaaacgtttaggtatcaggtcaaattcgatgatagtttctttgaacgttttaataccatgaatgaagatgtattaagcattctgaaatcaattgatgccgagaaaatggacgaagatagattagttgctatgcttggtttaccttatcatcatgaaaaggaaaagtcacttatggcaatgcgtgataccgtctttgatttatcgaaaacaggctttattaagcgtattactgatgaaaaagaagattactttacgcacctcattttgaatatgccagataagatgcaatttttatctgttttgccagaaatacaatcatacaaatttccggttgaagtgcatatcaaaatcaatttccctcaacgtgacggttggcgtggtttgaaacaacaaactaagtcatcaaaagggaagtatcgtgatgaattgcgtgatgcctttaataccgatgaagatagttcaaaacgtagtgagttgaattacaagctagccaaaaacttagttaatgttcttgacgataaaaatggttttctgcaatggtcagtcattttagtggttcgagatgaaaacgtcaaagaattgaagaaaaaggtcaataaactcaagacacggctaaagacatttgagcgtgatattgagttgtatcaaccaagcttcaatcaagaacagctattgtatcaaacattgccagcggttaatttaggggtcttcaaacaatggcgacaatacacaactgtgccagccttagccgagttgatgtttggcactagtcaagctttagggtcacacacaggtttctatgttgggcgtgttttgagcttagataagtttgagactatccaacaagccgtggcatcttccagactattattactacttaatttggtgattaccaacaaaggtattaaaggtgctaaaacagatagtccgcaccttgcattatcaggcgataccggacaaggaaagtcatttttgtttaaactcttattgcttcacatggcaatgtttaacgtcaagattttatatattgatcctaagcaagaaattcataggtggtttatgcgagcattagaaaccgaaaaaaacccttacttccgtaagttgattgggtcatttcattttgtcactttaaatgccaatgatagaaaaaacttaggtgttcttgacccaattctaactttgaatgagcagagtaccgaagatgatataccagatgtgctgacgttggttaaagaaatgctaggacaagttcgttctgcatcagtagatatagatgttgatacatcattaaacgatgccatttatgaaatttgtttacgcagaatacaaggcgaaaaagtcgggactttgacagtttttgatgagttagctaagggtagtgagaaagaccaaaggttagctaaaaactataagagtattgttccaaagacaatgttacgcttagcctttagtgacggttcaacagatagtttgcaatttaacgaccaacgtacaattttagaagttactggtttgcaattaccaaacgctaaacaagatagtcgcacttatactgatacacaaaaatattcaatggttttgatgttagcacttggaaaatatcttgaaaagtttggtcgagccaatccagatgagtttagtttggaaatgattgatgaagcatggatatttacgacttcacaggctggtaagaatgtgtttgatagcatcaagcgattagggcgttctgaaaacaacgctgttttctatgccacacagcgtgtcaaagatagtgatgatgaagaaagtatcggacagtatggtcaattatttgcttttgatagttctgatgaccgagagaatattttgaaacagttcaatttgccagtgagcaaagccaatattgagatgttagctaacctgaaaaaaggtcaatgtttgtttcgggatatttatggtcgagtgggtaaagtggttattcactcgttatttgatgaatggacggctgcgttaaagacggttaactcaaatgagagtgccaagttagaagaaaagtatgcttagaaagtaggacagtatgggaaatgtaattttatttttgatttttggttttggtattacctttttgtatgtccgccacaatcgagattttgaagcgttagatgatttgggtaagacaatatataagaccaaagatttagcgtttatgataccgcaagcgagtgatttggctaaagctattcaaggtaaaactggtgtgatcgctggcaacacagtgacatcttttgataaaaagcaacttactctaaagattgaagctagcgattatacgatcacagttattttggataaaaagcgagatgtggtgcgctttgatgttaagaataggggtaaaggttgatgactaatgttaaaatggcagatttacagccaatgtctttgggttatgaagagggacaagatgtaaccagagaagttctacacagagcagaaaaagcctatcagtattttcataacaagtatttggaattggtggcatcaggggttgagccagaattgcgagaccttttgattggtcatgatgcctcattggaagattttgttggtagagtgagacaagttgttaagtcaggttattattatgacagtatgggcgtttttggtgtttatttggaatataacgatacttatgctgaattaagagattacttgaatagtcgggggtcaattgatgtctagtgtttttaaaaaatatcgtatgacacgaaaaaatgtgttgttattggcaaaagcgattatcaatgttcatggcaaaattgcttggcaagattatgcgagtgatagtccctatcccgaccagcacagtcttacattgaatgatattaagggcagtcctgaaaagttagaacgctttaggaatgagtttacgcatcaaatgtatgataatgttattaatgatgaaatgcagagattggagcatgatatttaactaatagctaataaacagaaagttcatcaatgacaaaaaaataacaaccacaaatttatggtgttattgtgcatatctattttataatcgacatttccatgtttacgacttgtatttgatcacttttggcacggctgttgttgatgtctatattaactactaaattatatctaatcttcaaaatcaaaggtttttgagattgaatcgtatatcctagcaagtaaacatgtggttttgtcaatttttcaacatatagactatcatcatcaaaattgctccagtcaatgctttggtttttgtccgtctcatttttcaaagcatttctggctagtgtaaacatttcttctttttgttgattacctgataatttatttatcttatcagataatatgatgtggtttgtagatgaattataatatggaattttatgtgaattgtcagaaacaatgataccgattattcccgctacaactacgaatatgccaataaaactgatgatgaaaactcttttgcgcattttatgctccttatagttcatgaaagccaattctttcaccatagcccatgttttttttgaacagtttttgtaaggcttaatgtataattaaaacaattggactgattaggagatataaaaatgggaaaagcaaaattgtttggtacgattgggaaaatggcacttggagcagtagcaccagatgtattggagcaaggaactaaaatcgttaatgatcaattagagaaaagaaaagactatcttaaaatacccgatgtaaaattattagatgttgaaaaagcaacagcggtaatagataagtataactttaatcactctgaagtaccggtgaaggcagatttacattatgctgatgcattgccaaatactattgtaaaaatggaaccaaagggaaatacctctgtggctccaaacacttttgtgaaattgtattacatcgatgaacaaacacttattgatagtcaacttttggctcaagaatcagaaagtaaaaaagcgttaaaaaaacaaaagacacaagaacaaattcataatgttttagaaacaacttccagtgtgtctgctaatattggtaacaagttacatttgaaaaaagtaaaaaagaatgacgataaagcataataaagaggtttgtttatgaaatataaaacaattaaatatagtgatcaatctttggcaaagtctttatttaaaaggactttgctttttaatttgtttttagtaactatttgttttggtttttggtatttgaatatttttcaatcgttgatgcaaggacaatatagctggtggtatctgtcaccaattgttttaagtattttgttgactggtttggttggctggggcgtgttttggttttacaagcactatgcgccagaacattcggactttatttcaaagtatttgaaaacagttgaactacgccagatgataagcttgctgattgtctctaaagggttctttgatactgctaatgatgacaatgggacattcatagcttattttccaaaattgaagttaaaggtattgcataaaacaggtcaattaattttacaagagccagtagacggccagaaatacatggaaagtttttctaaaaatgagtttgataatgtggtagaaacggcattacttgctgataggcaaacaactgaatttagtaagaataagatgattagtacctttgcttttgacccaattaaatttaggcgacagttaaaagaattgaaacctaaaaaagggctattgcagatttcaaagggtattgattggaagtatgatactgtctacaatgctttattatcaggtaatgttggtactggtaaatcgtatactatgtttgcgattatcggacagttattacaggtcactaaatttgtttatatcattgacccaaagcgttctgatttagcaggcttaaaacacgtacctgaattgaaaaataatgtttttagtgtggcatctgaaatcaatcaagctgtgatagatttttatactaaaatgatggttcgtgctgaaaaaattgaagcaattaaagcatcaggtcaagttgggacttataaagattttgggtttacaccttattttttggtgtttgatgagtttggcgcttactacgaaatgaacgatagattggcttatgatgacccaactaaagctagttatgagacggcaatgtcaaatcttagagagattgctatgttgggtcgtgaattaggtttttatattttgattggtatgcaaagacctgatgcaggttctttgccgatggcagtacgtaatcaattgaatatgcgtattaacatgggtgtgccaacaccagaaattgaaaaaatggtgtttcctgataatgaaaagcagttgcgccctttgtcatcaaatttgaaagggtggggctttattaagattggggacggtcaagttaggtcattttttgcaccagaagtaccaaaagattttaatttacatgaatatatgcgtgaaaatatcgcaataagagaaagtcaggggaaataatggcagatgatattatggcaattgaacggactaggttaagtctagttaacggttcaaggaatatggcgttgatgttagataagttacgtgcgattgatgccaatgaaatgactaacattagaaatattgttaaaaatattgatgttgaaagtggcgcaattgaaaatgaaaaagcgttacggcttattgaagaaataagagatgttgatgtatttaactttacacaggatattgtcgatttgatgaagaatattgaaagttctcaggaacaactagatgtttatatcaaggcatttagaaaattggtctaaaacagattgacttgtgaaatttgaaaagtagcgtgatgaaataggcgttttaaggactttgtgaaaggttttgaaaatgacctatttttttgtccctataaacgttgatatagcgttactttgtatagccgaaattatgtaaactttgattggtctagtttgttttcctttaattatatagttatgaatgacaagtatacttttattgttgacaagcatacttgtcatgtatatacttattgtaaagaaagaaggaaaataaaatgaacgaaaaaaagtttttgaaagtagctcaagcagaaaacagggacgaaggaaagctatctgaattaaaaaatatgacagctgtacattatgtaatgttattactagcatggcttattgtgtttgccgtcaggctctttcaaaacgaaagaaccgaagatttgttcttcatgattctttttatggcactaggacatgagctatatatgttaaaaaagaaaatttcatttgtcactattatcactgttgttatattagttattgcaactgtaatgacagggtggtcacttttaagcgtgctgtttgtatgagtaatgatcgattagttttaaaaaataaattaaaagttgcacgtgccgaaaaaagtatcaatcaaaataatttagcaaaattggtaggagtttcacgacaaacaattagtaatattgaaacgtacgagtatattccctcggcaaaattggctttgttgatttgcattgccttagataaaaaatttgaagaattatactattttgaataattaaaacgacatgacatagctagttgtgtcgtttttgttttgaataaaggagttgttaaaatgaaataccacgcaagaagtccaacatttagtatctgtgtttggctttgctgttgattaaatatttgtagcttaaagagaaaaagtaggtaaaaattatggctttagaagttaaaaaaattcaatctttgtccgctcaagcaattgaagatttgaaggcaattgaaaagataggtggacttgaacaccttgctcaactaagtgatgaacttaaaaaggcaatggcagatgaagaacagctacgtgctgttagtccaatgctgccgccttactttgctgaactacgcaagaatttaggtttcttgcttggtacggctaagtccttgcagacacacggtgttaatcgtacaaaggacattgagggtcttttggatcaattgtcacatatcaagtaagtaactattgttaaagctctagccttttacggcaaatgtcctgtgagagaccagggctttatgtacatagtgactttattttaggcgtggctcgaccaaaggaagagacagtgccacgccttgccctagcgtagcgttggggctgggtgcgtggtcgctgttaagcaaatgcaaagcatttgtaagcgactggcacatgcgccaaaaataaagtcaccaaaaaggctttaacccccagttactaacaggggggttaaaccggtaaaagcgctgaaagcgtcaacccaatatggggaacaaacgccgatatgaagccatttagattaaaaaataaaaatgttacatcgacatacccaaatgtaacattttgagaaaggaaagccgaaatgataaccattaacaatgagccaacagcttatacacctatatttctaggtacaacacaacatagtttacggttatcgttgcaaatacttatcatggtcggtatgaaatttaatgatgaaattgttgagacttataacgtaaccgtatcagctattgaattgggacaattacctaatattggtagtgagattgcgattgatgaaattactggtagtgaattatcaggctttaaggcaaaacttaaacagtctgatgcacagatgcaaaacacggcttcaactgaattagaaaaattagttgatttaaaaaatgttggtcgataccaactattgaaagggaaaaatattatgacacaagatatgaatacacttgagtttgatgcaaaccatttaaaatatgttcgtcagatattaaatgctagtcaagatagcctagctaagcaattaagaataacacgccaaacagttaatcgctttgaaactggggaacaaaaaatatcagataaatttttggataaattgttagtagcatatccagaattagcagaaagtattgaagtgcaatttgattgggtttcattgacattcccagatttaacttcaaagcaagtgattactgatgtgttaaggcttcaagaaaatttgtttttggaacgtcctacgtctcaaaacttttatactcgtgaaatggcattcgctggcgaaaaaaatatttacatacaagattttgcgccagttaaaaacccagaaacacaagctgtggatcaaaaatttgggacaacactttatttaactggtaaagggacacggctgtttgaaaaagcgctacttgaacaaaacatgaattggcgtgatttctttgaaaaggcaagattatatcgggggcatctaacacggttagatattgcaatcaatgataaatggggcttattgaatatgaatgaccttgttaaggctgtgcaagaaaaacgtttttggagtaaatcaaagtcttatgcagtgcatggcaacgttgatgacggctggacggttgattttggtaagtcaccctttgttattcgtgcttatgataaacataaagaacaagccaataaaggctatgacaccgatgttaaaactcgtgtcgaattagaattgcatcaagataaagccgaatatgtacttgatgagtggcttaatcatgataagaaattggtggatataacttttgatattttgtacacctatctttggtttactaatgagccaattgatgagcaaaagctaaaatcagataaagtacgtgaagtgattgagcaaacagttgagccgatgcctgcttggtcgttgctgacagctttaggaaatcgaatgaaatttgttaggcaaccaaaaaagcaaagtgttgaacgtattgaaaaatgggtcttgcagtcggttgtacctagtctagcagtgctaaagaaaacaggacattggcatgaaattatagaagcgatcaatagtgtggaattgtcggctgaacatcaaaagctggtagaagctaatttggttaacgctatcacacaagcaaacagtgttttgtatcaaggtaatatcaattttgacaaagaaaagggaaagtatgatgaagaaacagcagaatttgagaaaaaagccaacctaccattttgaggaaagtttggcaaaaataagtcagtggtttaactggtttgacggtctagtaacttgggtatgtaagccttatttaatttggttaggtttggaatgctttatatttctagttttgatgttagcagaatctatgaaaaaatcattcaatcgttcattagttcgtgaagcaccaaatacatttgcgcatcttccagcaaattatatggcatcatggctcaatatgatgaatatattgatgttgtcattattgatactaccgttaataccagtattcattaataatgtttggtatctattcaaatatctaagaaaggggcatgacaatgtataaagcagttggttggcattcacaaaagaaataataacatctatagaaaataataaaataaatagcaatcctgattttaaagcaggattgctatttttcataattttactatattattaacagagaggaaacatcatgcaacgacatagaatgagaaaagtattatcaatcataatggcgggaatagtattgttttcgattggttggttaatatgtttgaaaaacaacagcaaaaatatgacacaacaacaattacctcaaaaatggcatttaaacggcttatctaaaaatgggttatcaaatgatacgcaaactattttaaaaaatggtcaaaaatatgaactgttctatttggtggacactggtaagggattggaagcaaatcaacaaagaactcgttgggctcgttcggtatcttcagatttaacaacatttaaagtagccgatagcgccgatatcaaaccagtttcccaacaagaatcagttgccacaggttctattgtcaaagacgcagataatttatctggacatggtaaaaactcattactggcttatgctacgaaatacattaatggtaatcaatggacctatatgtggtattcgactaatcaaggtgaaaattggcatgttgctcataatggcaagccagtagcaaaaccatataaagaaggaaaagattttcgagaccctcatgtaatatatgattctgatgccaagcaatttgtcatgacagtagctgaggcggatgataacaatcatatgaaaattggattttatatttccaaaaacggcacaacctggcaatacacagatagcttttattcaccacgggatttaggtactttagaagttcctgaaatacatcaaatttatcaaaaaaataataatcaaaagcaatggattttgttttttggtgctaatggttttgctgatgattttcaaaaaagtaccggctcatactacgttgttggtcaattgaaaaacggccagtttgaagctgaaactgatccagaacgtgttgattttggtactgattattatgctgcacacaattatcaagaaaataatgaacaattgcttggctttggatggatgggtaactgggattatattaatcgcgttagtgatgatataaagtataaaggcaattattcggcgtttagaaaaatgtttttaagttcagataatagattaaaaacatcaaaaattattactaatggtctatttgacacaaaaaagaaaacagctctggtgagggcgcacagtaaaagtcgcatcaaaaccaataaagctgcttacaaaattagtaccgttgtgaacggtaaccaaaaattgactattagagctggcaatggagatagcaatgtttcctttcattttaataattttgacaaaaaactgacggtacatcgccaaagtaattatgttacaaatgatgcttataataaggactataacaccaatttgtggggagattggtcagaaaaggttgatttttacgttgatcaatacagtattgaagtattctggacaaagactggacaagtagctacgtttgctaagtacagtaatgatagtggtgataacattgtattcgataatttagataataaaagttcaagcctagtcgttcaggaaatgaagtaaacataaatctcataatttgatataattctatgaaggggctattattaggctaaccgtttattggtcatatgactaaattaaggacaacttaacaacatgcaagttgcaaaaaactatttatacactgcggcatatcagctgcttaacattattgcaccattaataacaatgccatatttagcgcgagttcttggtcgaaatggtgtcggtgttgcaagctggactaattcgtttgtaacctacttcttattgattgcaagtcttggaattgttacatatggtagtcgcgaaattgcctatgtaaaagacaataagcaagcaagacagcaaaaattttgggaaatccaaattattcacacgattgctggaatcttttccttagcgctatactttttatttttgaagtatggtgtgcaattgaatagtaatattgaagataatcaagtttatctaatccttcaaacttgggtcattatttccggtattcttgacatttcttggtactttatgggcatggaggatttcaagaaaactgtcctacgaaatgccctcgttaaaattgcaatgacagtattgatatttgttttagtgaaaacaccaaacgatatcggcaattatattttgttactcgggctgtcacaagttttcggtaacttgtcaatgtggttttatttatttaaaaagatatcattaccaaactggcatcaacttgatttaaaagaacatgtgaaaccaatatttatgatgtttttaccaactattgcgactcaagtttatttacagttgaataaaacaatgttgccgttctttactaattcaacagattcggctggattctatgataatgctgatcgaattataaaagtctcgctggcactggttacatctgttggaactgtaatgctacctcggatgtctgcccagtttgccaaagggcaatttgacaaaatgaagcagaatattacacaatcgatggattttgtctccgcactgtcagttccaatggcctttggaatggctgctattgcccctacagccatgatttggtttctgggtgagcagtttaaagtagttggtcaagtcattgttcttctatccccaattattattttcattggctggagtacggttattggcacgcagtatttggtgccaaccaaacgtctgaatgaatttacactatctgtcactattggtgcattagccaatgtgctacttaatttctggttaatttatgtggcaggagtgaatggtgctgcggtggctacaacgatatcagagttcttggtgattggttatcagctatacgttacgcgtaaagacatgaatatctggcatcatttttctgaaatgtggcgttatatcattgcgggattagggatgtatgtttcggttacgatgattagtcaatatctagaaatcaacatcaaaagtacatcaatagaactggtattaggtgtctttatgtatgtcctaattctcattattttacgagcaccaattcttaaaaaaatacccttactaaataaaatagcgaaatgacgctttttttctggtataatggtaaagttatatcatgcacatatgtgcacgaatgaggtggaaaattgaaacgcaaactaggttatttaaccgcaaaacggggtttagatattagcgtatctttggcggcgatgtttctattgtcaccagtgtttgctattattgccttaattattattaaagataagaaaacaagtaaaattatttatgcacaagagcgagttggccaatatggaaaacgctttaaaatatataaatttcaatccatggttgacaatgctgacaaaatattaaaacaagatgctgatttatatgctaagtttgtagctagtggttataagctacctacagcggaggatcctcgaatcactaaatttggagcattcttgcgtaaaacatctctagatgagttgccacagttttggaatactttgaatggaacgatgagtattatcggaccaagaccagttgtagaagatgagttagtcgaatatggggaagatattgataagtttttatcagtaaaacctggtgtatttggtttgtggcaggccagtggtcgcagtaatattgagtatccagaacgagcacagatggaattagattatgttgatcgtgctaatttgcgatttgatttttatattttgtttaaaacagtaattgcaatatttaagcgcgatggtgcattttaatttttaggagagaaaaaatgagtttttcgttaatagatttagttaaacgactgttgaaaaatagttggtggattcttattctggggattgttatgggagcatctctttacacatatgcaaaacactctgtgctgacggcatatacggctgaacgatatgttattgttgcaaaaagcaacacgggggttaaggatccaaattctcgtgtgcaagcagatcaaatgttaattaacacttataaaaagattgctagcgatccatcagttgttaatcaggctaaaaagctatccacagtgtctgttacaaaaaaagaaattgtaagcgcaattactgtttcacaaccagaccaaacgctgatgatgcgttttagtgcttccgctgcaactgccaaaaagtcggttgcaatcgctaacgcatatgctaaagcattttcaatcgaaggaagcaagttatatcctgacatggccaagccattattgttatcgtcagcgaaaaaggctgatgtactctccggcacagtttatagccctaagaaattagccgtatttgggtttgcctttggtattaccttaggcgcatttatcatattgcttactggtatttttcaaaactataagcgaatgatgactaagacaacaaagtgaggcaccgctgtggcagcttttttactaccaatcacatttttctctaaaacatattcatatagttttgctgaaacaacaatgatgattgcttttccagtatttgtacttttaatattgttgcagatatatcgctttccatctcgtattgcaaaaattattcctagcgcgcaatcttttttgctagcgggattttttttggttatgcaatttatcgcgatgtttttaagttatcagcattctggtgactcaattcaaacaactggtattattcgttcaatgatttttttggcggggtggattgtcactgtctatatgtcttgggcattaatcgtcctcacggtcactaatcataaagaggaacgattatttattaaaagtggactgattagtttactgatatacatgggaatcgttttggttccacagttgttggtgacactgaataacttttctatacgtccgtacgttaatgccattgcacgtctgttcgaacgacattggatggggcgcgatttctatgcagccggtagctacgcagttaacaattatcgattgaatggttttgaacctgaagctgcttttttagctaacctattaggtgtcgtttatttgccaatcattttaggtatcgcgataacaaaacaaaatttttggcattttaaaaagcacgttgccttagaaaaatggtttaactgggcctttattggttcgattttaatgtttttggtacttgcccgaacaacaacgggactgatcacattagtggtagctgccgtactctggtttttatggagtaaacgtgatgataaaattattttaattatttttggtataatggctattgttggtattgcattaggatatttcttcgtgcagccaatacatgatattttttataatttcttattcaacaaacaagggacttctaatcgactaggtggcaccattgccttagtgctgacattcctatcacacccactctttggtgttggttatggtttcacagggtatttcattatggattacgtgccaaagtctacgacctataatccagagtttcagcaagtgtacaggcacattggttatcctgtgctcagtgatggaattggttggtttgcgacgtatggtttggttatcatgataccagcattgtggatgctagctcgtttaatcatacgttcgttggtagtacaacacgagcttaaaatacgtcaaccagaaaattggcaatggcatttaggcactcagattagctttatgattatgattattttagtcgctgtatcgtcgttgtttgttattcaaattttcttatggccatatttgttgatgtttttcttttatcggcaaatgctaattaatcaagaaaaggagttagcattgtgactttatacattgcaacacataaaccgtatatcatgccagaagatagcgactatcaaccaatatttgtgggtgcggcccaacatgatagtgtaccggatggttatcaatctgatgctgttggacaaaatatttcaactaaaaatcctaactttaatgagttaactgcaatttattggattcggcacaacacagacacaccggtcgtggggctacttcattaccgccgttatttgggtaaaaaaaagggtcacagtttatcggctatcctaactgagtcacaaactcaggaattattgaaaaaggctgatatcattttgcctcaaaagcgaaattactatattgaaaatcaacgtgatcattatttacacgcacacacggctgaaccttataatataatgaaggaaattattgctgcggattatccagagtatttacctgcttttgagaatatggaacagtcgacatcggcacatctttttaacatgtttatcatgccgcgtaggtatttcaatgagtacacagatttcatttttgaagtgcttggcaaagtagaagcaaaagtagatgtggataagctcgagggtcaagaaaaacgggtatatggttttctaagtgaacgattaatggatacttgggttaatacgaaaaagctcactgtagcagagtgcccagtaatagaattagagcgcacaaactggttagataaagggtataatttccttaaaagaaagtttttcccaaatacaaataaaaaggtacatttctaatgacaaatcaatttaatacaaaaaattatgactatttaatcgttggtgcagggccatttggcatgatttttgcacacgaagctgctaaacgcgggaagcgctcacttgtagttgaaaaacgtccctatattggtggaaatacgcatacgcacacagaacatggtattactgttcatgacttcggtgcccacatattccacactgataataaagaggtgtgggactatattcgtaaatttgcggaatttaatgggtatcaaaaccaagtggtggccaactataaaggtacgctttataatttgccatttaatatgaatactttctatcagatgtggggtactaaaacacctgatgaagcacatgcaaagattgaagaacaaaagcaaattgcactaaaagatcttggggatcgccaaccacgtaacttggaagaacaagcaatctcattgattggaacagatatctataacaaactcattaaaggttatacggaaaaacaatggggtcggaaggctactgaattaccagcttttattattaaacggttgccagttagatttatttatgataacaactatttcaatcatcgttaccaaggtattcctgtaggcggttacactcaaatttttgaaaatatggtcgcagaatccaatggattagttgatgttttgacagatacagatttctttgattacaaggaaacgttgctatcagaatttccacgtgttttgtacacgggcatgattgatcaattctttgattataagtttggtgaattagaataccgttccctgcgttttgagcatgaggttattgattcagacaactatcaaggtaatgccgtgattaattacacagattccgaaacaccatacacacgggtaatggagtggaaacatttggacggcctcgctgatgaaggtaaaacaatcatcacaaaggaatatccacaggaatgggatcgatcaaaagaagcctattatcctgtcaataatgacaagaatacacagatatacaaagcatacgctacagaagctcgtaagagccatccagaaattatttttggcggtcgcttaggaaagtatcgttactttgatatggatcaagtcttcaatgacgcattcaatactgtacgtcaagagtttgacattgatcaagagtttaattttgctcacgatcaagtaaaatagctcaagcccattagggcgtacataacgtatgaggggaatcataatggaaagtacagtccaacgacacttaaagaaaaatatattatcactagttgttcctgttcataatgaagaggcaacgattaatattttctataatactattgagaagctcaaacctaatttgactgctgatgtccattatcattttattgatgatggctcgacagacagtacactatcgatcttacgagatttatctaaaattaatgataatgttcattatattagtttttctcgtaattttggcaaagaagcgggcctttatgctgggttacagcaagcggatggtgactatgtagctgttatggatgttgatttgcaagatccacctgaacttttgccagaaatgctgagagaggttcaaaacggtgaatatgatgctgttggaacccgtagagccaatcgtaatggcgaggcaaaaattcggtcatggttttccgagcaattttatacttggatgaacaaaattagtcaaacgcatcttgttgatggcgcacgagattaccgtgtcatgactcgacagatggtagatgctattttgtcattaagtgaaaatcaacgttttagtaagggtatctttacttgggttggttttaacacgaaatacataccatttgaaaatcgtgagcgtgttgcggggaacacatcatggtcattctggtcattaacaaagtatgctattgaaggcgtagtttcattttcaacggtacctttaactgtgataacggtgctaggactattatcatttgttttgtcactattgagtgctgcctttatagtgattagggcattgcttaacaataatagcgtcgctggatggccatcaatggtaaccattgtgctatttattggtggcattcaattattgagtctgggcgttataggtcgttatatggctgctatttttttggaaacaaaaaaaaggcctatctatatcacaaaagaagaaaagtaagaggaaatttttgtgatttttaaattattaaacaatataattattgttataggagttgctttcttttttttagtgtctttgattgcaacttttcaacactcgtcaaaccagttgtttaatcctctcactttgctatgtggatcagttctgttatttatactgctggtactttttttaaattatttccaaattatttctaaaagactgcaaagaattttattttatttgtttgttggtctaattatttttactcagtttactataattttatctacgcataattcacctttcacagacactggatacatttatattcaagcacaaaatttatcacacaatgtttctgattggaattattatttcaaaatttatcctaataatgtaaacattgctattttttggagttttatatatcgattctttaatttttttcacatagtcaatcagctcagagctacgtacattatccaattattgatgttggatggagcaatcctttttactagctatactgtaaaaaagcatatcaatgttaaactggggaatatattattattctcgttactgttatatttacctttaacactatttacagaatggatatataatgacagtatttcatctacattagtgattttgttactcggtttactttgtcgtgtttggtacagtcagtctagatttaaatatttttggtttttcttggcagcgttagatttagcttttactttcatactaaggcaaaatagtgttgtgattataattgctttattgattactattgttttgatgggccaaacacttcgtcaaaaatttgtacaaatcagtattctaatagcgactgtgattgttgtgtatttcgggtcgagcgttatacaaacagctcaacgctatgaacgtaataatcaggttgtaacacctgctacaagatacattaacatgggcttgaatccaaatacaagcggacaaattgatgggaatgacgcttggctgtatgaacaacctggacggactcctaaagaaaagaataggctatatcttagttccatcaaacgtcgtctacttaactattcagttggttcattatcagaacattttctaaaaaaagcaacatatatgtacggtacgggattaaccatacaggatttcttttattggtacgccggaaataaaaataatctagaagaatcaattttagaccggtttggtgtgaccttagttaatggttttcaatttttttacatattgctgagcgtaatgacgtttgtctttctttggcgccatttaaaaaataagcgttcgattcctccagtagtattgtttagtgtgttgggtgtattaggtgtttgtgctttccaagttggtttgtgggaagttcgagatcgatatagcctattagctgtgccgtttactgtatttattttttcatatgcgttagctgaactagacattgtaggatggattagtcgattcggtagtgtattaaaacaagacgtaattaggtactttattataagtacgggtttgctagtttttggttacttatcaaactattcgttgacaacacagttagttgaaaaaaataacgtctcgattcatcagccatatgtcgcatatgcaggacaaagcgatgtaaaaataaaggctcatgacaaattaaaaataacatttgatgttgaaacaacgggaaatactggtattttttataattctgcgtatagtatttcttcagacagtaaatcacagcaagtaaaaaaatatttaccgcttcagatctctttgatgaatactacattgcataagtcaattgaggttgacagcaatggaaacacaaaagccaatactatgcagaagggaaagtatgtcttaaccttgactaatccaactaaccaagcgatttatacacagggaattattgatataggtaaggctgatttctcttttaacagtttgtacagaagtatttcggggcaccctgagttgatgccagttatgacagttgctcgatctagccaaaatactcttgtatcgaaaaagcaatataatgcgatatttactttattatttgttattttatgtatcattacatatatgtttcgtaaaaaagataagatactgcctttgaataaaagcaaaatatagtacctgcttgactttggcagacagcattaaatttttacggtataatagattttataacattggggagagtgcatagcactgttccttttttagaatggaaaataaaatgaagatacggaataaaatatttaaatttttacggcttaattttttgtttctttggttatcaattatcgcactttatattattcaagtgggagtaatgatcaccgatccgggatatggcactggtgattgggggcgtagtgcttggacaaatggtatccaatttgtcatcaatcaaacgacctcggccggtataaacgtattgattctaatgatattaatgtggcttattactcttattagtaatcggataccggtaacaattatcgtaatggctgttttaacagccatcgtaacggttgctgaataccaattgattaacgttagacaagaagcaataaccgaggcaagtctacaagaagtgacggcttttggtaatttgattggaatgttagatatcaaattagtaatagcttttgtggtaattctaattgttatggcggtgttacttttcattatttaccgtcgcagtaaatggattgtctttagatcaattcgctggcgtgcagtattaatgattatttctattttggcgttagtgcctttcttccaaataaactctgatcaaaataaagaaacctttattaagctcggggatgatcctaaagtatgggattcactttacgatgctgtttctaatggtggaattgtcgcgttgctaaattcacgaacgacagatgcgatggtacaacctaagggttatagtcaggccacgatgaagaaactggtaaaaaaataccaaggcgaagcaaaaagcatcaatgcaacacgacaaaataaaaactttaaaaaccaaacagttatttatacgctcagtgaatctttaacaaaaccaagttatgtgccaggattgacaattagtgataatcctttaaaaaagctcaataatattatgaatactacaagttctggccatatggtttcctcaggatatggcggtggtactgctggaattgaatattcgaccttgacgggatttaatatcacagcgtataagccaacaattacgatgccgtattcacaattaacaagtagcattaatgaaaaatcaacggtcactggacagtttgataaaaaaattgtggtccatccatatgtgggttcgttttacaatcgacgtgctgtgtacaaaaatatgggtattaattatttctatacaactgacagtgacacaccagtcaaatatacagcttcagttggtggcggcaatcatgctagcgacacttcagcatataaaaatgtgctttctaaaattagtagtggtaatgacagccaattcattcaattattaacaatgcaaaatcatacaccttggacattttccggacgtgattacaatgttattgagccaactgattcaaatgcagatttggatacgatagaatcttatttgcagggacttcattacacggataacgctacacaagcatttcttgataaattaaacaaattaaagcggccggttacactggtctggtatggggatcactggccaggaatatttagcttcgtgaacacatctacagatgctttatcagcgcattcaacaccctattttatttggcaaaatgatgcagccaaaaaagctaacggtacagttgatgtttcagaaagctatgcagacccatctgatttcactgcaatggtgcttaaaatgaacaatatgaaggtcgatccgtactgggcattgaagaccgaattgcttgaaaaagtaccaacaattaacaactacaaacgtgatgagaatggtaaactgtcatttattgataaaaacggaaaaaatattgatgaaaaatctttgacggcagaacaacaaaagcttgtgaaggattttaaactcgtgcaatatgatattacgacaggtaaaaactatttactaaaaacaaagtttttccagaaggtgaaataatatgacaaaaaaatatttaaacgccttcttaacggtcatcattgctttaattggcgttgtgtatttaacaaaagttacaggtgatttacatgcttttcatggattaggtaagctggtgagttacttttcttggccgttactattggtgggccttgcgcgattggcatcattggaagatcgtaaaccaggtgacatctttgattgttatttgctgctttcaaccatattagcagtcattggattttttatcacattgcaggtgattcctgtgcgcacaccatttcaatttgctatgggaaactggtgggatgctatctctgctggtgcacttggtaatgaggggaatttgaatacgcccttaggggaagtctggacgaaatacccaatcggttggtttttaatgatgacacccattgcgatgaaactagcccattatatgcatcaaaaaatttccgataaacgcgtactcattgtttctgcaatagttttgatgattgcgcctcaatatataggtgaaattattgatctaccattcagcttaaatgcagcattacttggaacaggtttgctcgttatgaacgatagtattattgtcaaatctactaaaatgcgagttatttggattttgatagggagcatcgttacgataattgctgctaaaatgagtggtgtgtactttagttatggtcgagcggaaaatatatttatttctgtttttggtttgattgctgcaataaaactcattgaattcttattagattttgtgacgattcatgtaaaatggaatatgtctaaaaaaatttttttctatacgactgttggttttttgtttatactaacattagtggtaaatttaacaatatttttgaattaaggaaaacaatatgtctcagaatgtcagtgcagtgattgtcacatttaatcgtcttactcttctaaaagaagtaattgaaagtttacagacgcaagataccaagctttcacacattattgtggttgataataatagtaaatctgatacgcaagagtatctaacctcacttggcaaccaaatcgaatatgtacgtttaccagaaaacattggtggcgccggcggttttaataaaggtgtgcgctactttatggagcacacaaccgatgactttgtttggttgatggatgacgacactgttgtgcatccagatacgttaactgagttattgaagtttgctgataagcaagatcaattcggtttcttgtctagtgatgttcgttggactgatgggcatcgtgcactaatgaatcagccagcaccaatgaatcgtttgaaagtaattccagaggatcaagtggaacctgtgcaactacaaaatgcaacgttcgtttcattattagtaaaacgtgaagtagttaaaaagattgggttgcctatcacggaattctttatttggggcgatgatattgaatataccgaacgcgccggtcgtgttgcacctggatattttgtaccaagcgcaaaggtgacccacaagatggcagaaaatgtgggtagtagtctacttaatgataatgaaaaccgaacaccacgttacttttattcttaccgaaataaaagatattatgcaaaaaaacgtgatttctatcgtcgtaatcgtgcgttactacgtatgtgggctgaatatttccaaattaagttttcgaatacagaacgaaagcaagaaaagcttgatatctttaaaaagggatttcaggctggtaaaacattcaatccaataattgaatttgcagatgatttaaagggaaaatgaaatagtgcctaattgggggctattttatttttaggagaaattcatggaaaaaataaagttattgctgactcagtaccaagaagctattttgtatatcgtatttggcggcttaacaatgttggttaacatcattgccttttggttagcctttcaagcatggcatatgaattcttctgtatcttatctttttgcttggttttggtctatcttttttgcttatcttacaaaccgaacttgggtgtttcactcaacagctcacgaccttaagacggtaatcaatgagatatttcagttcttggtagcaagaattgctactgccgtaattggctttgttattttttattttggggttaacttgttaaagcaagatgctcaaatctggaatatcatacaaaatgtttttgtaatcatttccaactttgcgttaagtaaattagttatatttaaaaagaaggcttgaacgccttctttttatttgttgtttttagctgcagtaattaaatcttgtgcaaatttttgtagtgttgggatatcgtttgcttgtgggtttaaattaattttgacacctgctgcacccttagttgcgttggtaagcgaaaattgcttttcgaattttggtactgctaagcaataatcatccaaatagtaggtatctcctgatcctgcaacaccgtatacgacacccgcaagatttgcatcagctaaatcatcataaaagtctaatccttcatctggcagtgagccctgatcatatgtataggggacaaccacggcaatatcgacatcttctaattcatcgacctcggtttgactaatttcagatttttttaccgtaacatcagcattttcaagcgcttcaataataatatctgctacatcttcattgttcccagtaagcgttgcatagacaacttgtgctttcattttatagtcctctttattttaattatcaaaagtaattatagcattttattaaactattaaaagctacgatttgacgaaacacctagaaatatgacggtttgttgacaaattcataaaaaacctttacagtctggttctgaggccttaatatagtttaggtgactgtaatttaaaacttcacatgcaaattttcaaccccttaggagattaaaaatgatacatcaattgttggctgaattcatgggtactgcgctcatgattattttcggagttggcgtccacgctgatgaagtgttgaatcgtacaaaataccacggttcaggtcatctgttttcgattacaacttggggttttggaatagcagttgttttgtttatcttcggggaagtttatattaaccctgcaatggcaatggtccaacttattttaggaaatattcattttgattatttcttaattgttagtttagtagaagtattgggtggtgttttcggctcaattattgtctatattatgtatgcagatcaatttaaattatctgaaaaagatattgatccagtaatcgttcgcaatattttttcaacagcgccagcaattcgtaacttaccacgtaatttttttgttgaaatgtttgcgacattcgtatttttgacaggtatattagctatttctgcaaaagcgggggatgttcctggtatggttccgctagctgtggctttcttagtttgggctgttggtatgggtctaggtggtactactggatttgcaatgaaccttgctcgagatatggggcctcgtattgcatatacaattattccttggaaaagacgagcctccagtgatttccaatacggtattcttgtgcccggaatagcgccatttgttggtgcaattttcgctgccttattttcaaagttttatttaggcctgtgaacgcttacaatccaaacgttcgcttaaaattataaaaaacactgtttcgttcggttaaaccgaactttttttatttttgtgagaaaatactaatttaattacgaacgcaacaagtaaaataactggtaaaataattgagtagagaaaattaaataaagttattctggagatgaatatgcacacaaacgttgaaatgcaagcattgctagttgatactgtacgacgaaaagttagctatcctctcaggaaaaaagtaacgcttgggatactgggtggcgttgctatttctttgggatttttagcagcaatacgtgcaatggcaccactaactgctctccaatctcccgttgtctctttggtcggcgcatctttatttccggtcggactaattatgattgtgttcactggacaagagttagctactggaaatatgtttgttcttggttacggcgctttaaatcgtaatttgggttggttacgttatttttttgaagtaatactgataactttgctcaatggacttggtgcgattttattagcctatatttttggacactatttaggactgactaaggtggatatttatggcaaacaagttgcgacaatggcaatgtctaaagtaactccaagtatgccgatgatcttcttttcggcaatcggtgcgaattggttggtggcgatgggtgtatacttaggtatggtcgccaaggataccattgggaaaatagtaggtatgtggtttccagtcatgatctttgtgttgattggattcaatcatgttattgctaactttttcttgctgccagctgcttattttaatggtacgattacactggtacaaatgttgcataatcttgtgccagcatttttaggtaacacgtttggtggcttattactcgctgcttcactttatttcacaaaggacaaaaataatgcttgaacgatattcacgagaacaactccgcgacatctggtcgctgaaaaatcaatatcaaacatggttagatgttgaaattgctgttgacgctggttgggtcgccgaaggccacattccagccgaggatcttgcaaaaatacgtgcaaatgcaaaatttgatgtagatcgaatagcagaaatagaattatctacacgacacgatgtagttgcatttacacgtaacgtatctgaatctttgggtgatgagcgcaagtggattcattatggtctaacttcaacggatgttgttgatacagcacaagctttacgtttgcgccaagcaaatgatatgataaaaaaagatttgcaagactggcgtgaagcaattaaaaaattagctgtgcaatataaagacacagttatgatgggtcgtacgcacggggtgcatgctgagccaacaacttttggtttgaaaatggcacgtttctatgcttcagcaacacgcgctatagaacgttttgaacgtgttgcggcagaggtagaaactgggaaactttcaggtgccgttggtacatttgcaaacgtgccaccacgtgttgaagaagttgctatgaaagaacttgggctaacccctcaaccagttggttcacaagtactaccacgtgatttacacgcagattatatccagacaattgccttgattggtactcaaatggaggagctcgctactgaaattcgttccctacagcgctctgaaatacatgaagttgaagagggctttgctaaaggacaaaagggctcatcggccatgccacataagcgaaacccaattggtgatgaaaacattactggattggcacgtgtgctacgtggttacgcagtaactgctttggaaaacgttactttatggcatgagcgtgatatttcgcattcatctgcagagcgtatcatacttgcagatgcaaccgcattacttgattacatgttaaaccgccatactggtattctaaataatttgggtgtgttcccggaaacaatgaaaaagaatatggaccgtacgtatgggttaatatattcacagcgtttactgttgagtttgattgatgcaggattgtcacgtgagcaatcatatgacactgtccaaccattgacagcccgttcgtgggatgagcaattgatgttccgcgacctagtagatgcagacccaaccatccaagcaaacttaacaaaagaacaagttgacgatgcatttgattatcattatcatttgcgacatgttgatgaaatttttaagagagtaggtctagcatgaaacctttaatcacacacccagctatcaaaggggtgttggcgacagaaacagatattcaagcacaggttcagcgtgtggctaatgaattgactacaaagtttgagggaaataaagaacgacctatttttattgccgtattaaaaggcggggttatcttcgccaccgatctacttcgaaagatgccactggatgttgatttcgattttgtagacgttaaaagttattcaggcgcagcatcaactggtcaagtcaaagtagttcatgatgttagcatggatttaactgggcgggatgttgttattgttgatgaaattattgattcaggaagaacaatgcagtggctgcacaattattttgaattaaagggtgcctcaagtgtgaccacagtggcattggctgataagaaagaggctagagtagttgattttgaagttgattattttggtttggaagtgccggatgaattccttgtgggctatggtatggactacaataattttttcagaaacttaccagtaattgctattgttgactttgacaaagttgatttaataaaataacaaatttaaaagcatctcattgagatgctttttgttgtgcaataaaattttgtaggttagggctgtatattagtggtttatgttgcagttccgtgatattttgggcaccaagtaatgtgaatagacgtggcaacgctacttgccatgcattaatttcttcgagtaatgatttttgacctttttccattagtgttgtgagcatgaaaccagcactagaagttaaagacgcgcccagcatgagactagttatgacatgattcacactttgaatgcctcctgtagcaattaagggtaagttatttttagccatttttgcttccagcaaactttcgacagttgatagtccgtaatgatctaaattaacagcttcagaaaggcgattacgcctttgttcaataatagaaaaatttgttccgtttgctccaccaacattgatagcagctggatttagatcggcaatttgtttgaaagtagactgactcataccaaagccgacttccttaattatcaccggaacaggtgactttgcgatgatttcagcaagattgtctagccaatagaatttgcgatcaccttcagccatgacaagttcttgggcggcattaacatgaagttcaatggcattagcatcaatcatatcaatggcagtacgtacatttgaaataggatggtcggcccctaaattggcaaatagaaaaccattgggattcttcttacgaacaattgtgaatgtatcacgagtttctggttctttaagtgcaatcgattgtgagccaactgccatagcaatatttgactcagcagctacctcagcaagttccatattgatgcgaccagttaaagctgatccgcctgtcatggcttcaatgtagaagggccatttaaagtggtgttcaaataatttggttgaaacatcaacttctgacacactcgtttcgggaaaagtattgggtaaccaacgtacatcatcataagttgcaccaatgacaggcattgtattttgacgccagagtttgacaccaagcgatagatgttcatctttacgatgagattgagcagattcagtcattttaacctcgattctgtggggcaatttggacgtaatgtggctcaatttcagctgcaagccacttttctggtaaatctgtaggtccattaacaacagcaaagccattatcaccaaatccagcaccactgatttttcctgcggtatcgccaagtgtctgcagtagaattgctagttttggcgtaacgtatttttgggataatgtgtgccgtaagatggtttgattcaattttaaaccttttgaaaattgcttgtagtcgtttttaataaccgattgaacgacgtcgtcagcgacatgttgactttctttgaaaaaagaagttggcaatgtttttgaggcgagtgccttacttgtattggcgctttcatgtgtggcacctaaaaggatttgccagtcttgcggccaactgaggggaacgatgtttagttttttccagggcacatctacaatttcaggctgtagccaatttttatctgccgtttgatattgagacaaatcagggctttggtatgaaatagcaccgccgtatgttattgctgcaacatcacctaatgaaccatttttctgcacatgcaagtgtgcgagcgcagcaattttaaattgagtcagtaacgttaggttgagtttgaaatggttattaaaagccgatacgatgcctacaaccacggctgcagacgaaccaagaccaattttacctgtaggatgattcatattacttttgatgtcaatatttacttcttgtaatgttgccctaatttttttcgtgtgaacataatgtgtcatcagattcacagccgcgcgaacaaaacgccagtcatcagtttgctctggcgtttcttggttgatattgaaagttagatcatctgtaatgatattagaagtaatagtagaaacttcacgggctgtggtaatttctattgctaaccctgtagtaatggcaacaacaagcgcggtattgccaggattagtaattgcatactcaccagccaaaaagagtttaccagggattaatattttagtcataagaaattccaggcccgctttgagcaatttcaagtttcagggatggtatggcatgatttagtatggtcacaattttgggcgcttcttgcattgttgtgataattttaacgtttggccctgcatcaattgttgcataggccaatattccttgatggcgcatatcttgtatcaaagataaaattaattgtgttttgtctgtaaaataagtgaatgggcttcttgtagctgttaaatttaaagcatgcatacccaaggcattatcttcagccaaagcaccaattttgtcaatatcttgatctaggatagcatgttgcatatcaatgaattgattagccgactttgatagccagcgatcataatttggtgaggtaatagcacgtttcattccctcagttgaagttatctttttaggcgcatcacaaacctcagcaacaaccaaggcaatgggcaattcaggcgcgttaaggctctcggcaaaagaagatgcgtcgtcaatacctttatgccacatggcgaagttaccaaaaaaagagcgactagctgaaccagaaccacgacgggctaagcgggataattcttccttgggtaggtccattcctaattcgtgtgtaacagctcctgttaacgcagcaaaagccgaagcagaggaggctaatccagcacttgtaggtacatgattttcagaaataacctgcagtggtgtaaaatcacccaactgttgtcgcagaatatccaaaaagcgatgaacacgagtggcgtcgacgacttggtcatttaaaataaaacgatcatgattggcaggttccacagaagttgttgtgtaaaacttgtctagtgttaatgaaagtgagctagttgtcggtagattcagttccgtattttttttcccccagtattttatgagggcaatatttgtatgggcagtagctttcataagggttgaatccatgtattctgtgcgccagctttattgagagcattggcaattgcgattgcatcattattatttctagctaaagcaaacatagcaccaccaatgccagcgcctgttaactttgctcctaaagcaccagcatgattcgcagcattaactagtttgtcaagtttaggatgtgaaatacccaatgattgtaattcgtgatgggctgctgtaaacatcatacctaaatgctcgggattattttcagaaatatcaatccgtattttttcagcaatttgtccgagatgactaattgttgaccaagcacgttcttgatcattaatcaaaaattctttgactatgctgacagcgtgaacggtttgaccatggatacctgtatcggctaataccaacgtacctgataagttcatttcgaatttttccattgttttgttcttgataaaccaaatcgggttgctcgaattaacggtggtggcatctaagccagaaggtgatccatgggaaatgacttcttcaatgtttgtgaagtaattcagttccgtattacttaaagtcgtgttaaagtaatcgaaaaatgctcttgtaatcgcagttgctagagcagctgaagcgccaaatcctcgttcttgaggaacatttgattcaatagagagaaggaatggcacattagtcattttaaatttattgattaggcgcagtaatagctgtcggataccttcaacgtttgcaccaagttcacttaaatcaccatggaattcagcaccatcgattgtttgaccacgaaatgctggcctcaatgtagcagtgaccgtcatatttggtaggggaattgcaatggcaggttcgccataaacaacggcgtgttcgccgattaatattgcttttgcgtgggattgacctacgccattcatttgacttaacataaatttctccagatgtactctactattgtaccgcacagtagtatttagtgtaaaatataaaagagaattgcgttgtttagtgcgcataattattgtgtagtaaacagcgcaattctcacataaaaagtgctctagcacgcacgtttagaaaggtgctttatatgaacgccaacgatacattcgtggttgtcgatcttgagaccacaggacatagcgtaaaaaaaggtggacgaattattcaaattggtatgacatttataaagaaacgtcaaatcgttgatcattttgaatcttttgtcaatcctggccaactaattgatcgtcaaattcagcagctcacgcatatatcacaaaaggatgtgcaaaacgcaccgtatttcgaagaaattgcaccgttattgcaaaatttacttcaaaatacagtgattattgcgcacaatgttaattttgattatccgtatttaaatgatgagttcgaaagaactggttttccactcttaaaatccgctgctattgacacagtacagcttgctcaaatattgtttccaacggcgccgggatatcgtttattagatttaacgacctacttaaatatcacgctcaaaaatgcacatcgtgccaatgcggatgcgcatgccacggctttgctgtttttgaaattttggaaaaaacttgaagaattaccggacattacattaaaacaattgcaacaaggtgattggccgttactacgtcaaacgcagcaatttttaaagcttgttcattcaaaaaacaagcaaaattttggtaccgttgagcaagtcgctgtattaaccactacaacagaacaaacaattcattcttctaaatctgcccaagttgattatccagaaacaagtgacgaaaagacaaagttatttgggcagtggttaacgacaaatgttgcacagaacagtttaatggatcgtgccaatcaattcttaaataaacgtactgatggcttgctgaccattttaaccggtccgagagttggaaaaacattggcctatttggttccagttattctaagtggaaaaacagcggttttattgactaatgatgagagtttacaagctcagcaagtagacattattactaatcttacaaaactatttagccgaccaatgcaaagtgctattttgtacgagccatcagagtatatagatgttgaaaagtttgctcaaactttagaagaaaaaagtacattgcaaattcaattttttaaagctcgtgttttggtttggctaacgcaaacaaaaactggtttacttcgagaaatttcggtaggtgttcaaaatggtgactacgtatcatcgattcgtggtgacagtcatgcacaatttttcgaaaaggcttataaaagtgcgcatcaagctaatatcattatcatgaacttcagcacatactttgtgcaaagtcagaaactgcgtgaagagaaaaagattgataaatggccagttgttgtcatggaaacaccaacgcaatttgttgatgatttacatgattattttcacgtttctttaaatgttacgcagtatcaaaacattttaaaaggattgaatcatcaagagattgctggtttgacgcataaacagcgcttatttgttcggcagagtttaagtgaagcattaaaactactaaaacaaatattgcaatccgataatcaacgggctaatttaaagcgcgtggaacggtttctactgataatattacatttgaaggaattatttgaaattagtgaaaatagtattcctcatgagttccaagatgctcgagatcaattgttgaagattagacgcttacagttacaaaatgacattgtggtggcaaatgaattttccgaagttaacggacaaactcaaactgaagtcgtattcgatattttggaacgtgcgatttatcaagcagaatttgtttccaatgttcataaattattaattgtgagtgagtttttaccaacagaggttacggaattcttacgtgatgtaccggagccctttactgttgagcgtgaatttgttcataatgatttacaaccaattcatgttgtacaattgcaacgtgcgtctccaatagtgcatttacaagctattacgcagcgtaatgttggagaaatactattaatcgtccccaatgaagaacgggttaatcattggtatcaaaaaataaaatatgcagtgacaacgaattataatattgtcgcggaaggaattactggctcgttggaaaaaatacaacgacagagtcaaaccaaacgaaataatattattattgttacccccaaaattttttcaaccatgtggcttagagagcaggaattacctgcaattgtaattgttccagaaagagaagtatggcaacctgtatcacgtctagcttatgttttaacccaaatgcaacgtcatcaaaatggtatattagtttctcaattgaatgctatgcaacgtaatcgattcaagcaacaaattgtcgttgaaaagatgaacttgaaaaaaggtttagaacagcaatatgatcgattattgcatgacctctaactcgcagatcaaaatcaccatattttttggtataatatcatgtgtacatgccattatggagggttcaaaaaatgatacaatttaaagatgatattcgaatccgccagcgacatcgccaagcgcgcattcattgggcgcacttctggttcatagtaatcggtattctgattatcctagcagcctttattttggggtatttttacgtttcattagctccaatgcgccaggcagaaaatcgagttgaaaaattagtacgtgaaaaaacaagcattgcaacagtaacacaagtatctgttaattatcgaaagacgaccacttatgctgttctagggcaaacaacgactggcactcaaaaagttgcaattgttcgcaataataaaataaaaacatataatcgttcatcaggaatgacagatagtcagctcaaaaaaatgataactaacaaatacaagccaaaaaagttatattcagctaatattagtgaataccaaggtgtattagtttgggagattagttataaagggcaggacaataaactaaattatttaacattagactttaaatcaggaaagacgtatcgtgccatttcaggtatgtaagaggtaactataaagtgaagactttttcgaatcgtgtgaatgctataactgcttctccaacgttagctatgaacggccttgctaaacaaatgcaagcagagggtattgatgtcattaatttaggcgtaggtgagcctgattttcaaacacctaaaaatatttctgacgcagctattgaagcgattcaagcacaaaaaacaagtttttatacaccagccagtggtttacctgccttgaagcaggcgattgttgaaaatgtcagtcagcgatatgaagcagctattactactcaaaatgtttccgtaacgacaggagcaaaattatcactgtatgtattgatgcaagttttactaaatcctggtgacacagttgttactgctgctccggagtgggtgagttatgttgaacaaatcaagctagctggtggtgaactgatagaggttcattcggaaagctcgtcgatgaagttaaccatttcagatttggacaaaattaaagaaacggtcaagttggttattgtcaattctcctaccaatccaactgggcaagtatatagtaaacaagaaattcaagatatcctagattggtcaaatacacatggggtctatgttattttagacgaaatatatggtcaacttgtttataatggtgctgagtttacatctgggttgcagttacaacatcttgaaaacagtgctatgattattgtggatggtgtgtctaaggcatactcaatgacaggatggcgtataggttggactttagcgagttcagaaattatttcggcgatgaataagttattgggacacatgacttccaatccaacagtagcggctcaatatgcagcaattgaggcattgaatggggagcaagacaccgttgaaaaaatgcgtcaagcgtttgaacaacgattaaatacgacttttgaggcaataaacaaaattaatggcgtacacgttgatgtaaagccgcaaggtgccttttatttatttccacaagttgatgaaaaattaatgaaacttgttggcgtaagtaatactgttgaattatcaacgaaaattttagaagaagcacatgttgctttgcctgccggtgagggattcggcatgccaggatatctgcgtttgagttatgctaaagaccaagatacccttaatgaagcagttttacgtttgacgcaattctttaaaaaatatacgaaagattaatatagtgatgactgaagaaatacctaaaattaagattattgatgcaaaaaactttgttggaaagacagtgactattggggcttggctccgtcaaaagcgtggtagtggcaaaattgcattcttacaattacgtgatggcacagccttcttccaaggggttgttgctaaagctgacgtgtcagaagaagtgtttgaaactgctaaaagtttgaagcaagaaactagtatttatgttactggtgaaattcatgaagatgctcgttcatctttcggttatgaaatggctgtttccgatattaaagtaattggtgaaagccatgactatccaattacgcctaaagagcatgggactgaatttctgtttgacgaacgtcatttgtatttacggcatctgaagccgtttgctactctaaaaattcgtaatacacttgttgcagcaacatacgagttctttaacaaagaaggctttacgaaattagatgctcctgtgctgactggatctgccccagaaggaacgactgaattatttgaaacggattattttggcgaaccagcattcttgtcgcaaactggtcaattgtatgctgaagctggtgcaatggcgtttggtaaagtatttacatttgggccaacatttcgcgcagaaaaatctaagacgagacgtcatttgactgagttttggatgattgagcctgaaatggcttttatggatcaagaggaaagtttgaaactccaagaacgttatattgctttcttgatctcaaaggtactcgagaataatgatcaagaacttgacattctcaagcgtgacaaagacctacttcgttcatatacgcagttaccatatccacgtgtgagctatgataatgcagtcaaattattacaagataatgattttgatgtggagtggggtgttgattttggttcacccgaagaaacgttcttggctaatcattttgctaaacccgtgtttattgttaactttccaaaagcaattaagccattctacatgaagcgccataaaacacgagatgacattgttgtttcagctgatttattagctccggaaggttatggagaaattataggtggatcagaacgtgatacggattatgactacctgaagaatgaaattgaaaaactagggttaaacatggatgagtatgcttggtaccttgatttgcgtaagtacggttcagtgccacactcaggatttggcttgggcttagaacgtatggtgacatttgtaactggtgaggagcatattcgtgaagccattccatttccacgaatgaccaaccgtttacgtccttaattatagttttgtatcatagtattcttactcgaatgtgatacactatttatataagaaaaacgtccaatttatttggacgtttttaaaaccgaggaaatatgacgttagaaaaaagattacaacagtatattcaagctggtaacactggcgtaagtaatgacttgttgttacattatcaagatgttggtctagataatgatgatttagcattgtatatgcaggtggagcgtattcaagggcggggagatcaagctacaccggcagctattgcccaagtaatgcacacgaccgaaaaaattgttattacgcgtttgcagagtttgataagacgagatttgatgcaggtggtaggtggcagtattcagactgaaacttatgattttacaccattatacgaaaaactattagatggtcaaactacacaacggtcggaaattgtgtcagatggtaagagtgctcgtcgtgagattatgcagacgttagaggcagaatttgggcgtccgttatcaccaatggaaatgcaaactgttgggcattggttcgatcaggatcactttgagccagtgatgatgttattggccattcaagaggctgttgcaaataatgcccgtagtttgcgttatattgaaacaattttggccaactggcaacgtgataatattactacaccacaggcagcgcaggtctctaagcagcgcagacgtggtgtaacatataacaatattattgattaattatttaaaaataatattgtattgattatcaagatgaaaaccaaaaataggttgattattttctgtgaggagaatagtatttgccggtagtgtacgcaaacgtgcgaatagttgtgatagtgtcatggcattagtctgatcattagctagcaatataatatccgaatgattatttgcatattttattgctgtcactggattaacaaagtcctcagtttgtactaataattttgtatcaagtgacatatattgtgttaaatcttctaaatcagttaatctcatacgctaattataaaggaaaatcatggaaaaaacatatcatttaatggcaacagcagcagcaggattggaatcgcttgttggtaaagagctagaacgcttgggctatgaacatcaagttgaaaattatcgagtacgttttgatggtacacaaaaagatatattgaatactaatatttggcttcgtacagctgatcgaattaaaattattgtgggtgaatttgatgcgacgacatttgatcagctgtttgagggcgttaaagcgttaccatgggaggattatttgaactatgattcagaattccccgtcgcaggacgttcaaaaaaatctgagttatttagtgtgccagatgttcaagctattactaaaaaagcaatcgtcaatagattgcaagaagcttatcatattcgaacacgtttgcctgaaaacggttattttgcacaacttgaagtgatgattgataaagatcacgttatggttaccttggatacaacaggggaatccctatttaagcgtggctatcgtgtgaataagggtggtgcaccattaaaagaaaactttgcagcggcactagttttgctaacaaattggcacccggatcgtccatttgttgacccaacaactggttctggaacgattgcgattgaggcagcattaattggtcgtaatatcgcacctggattaattcgtgactttgatattgagagcatggactggtttgataaaaaattgtcagacgaagtgcgtgatgcagctgaagcgcaagctgattatgaccgtactcttgatattgaagggtttgatattgacgaaaatatggttgatattgctagagaaaacgccaaacatgcgggacttggtcaggatatcactttcaagcagttagctgccaaagactggacaactgataaacttaacggtgtactggtgactaatccgccttatggtgaacgtttaggtgaactcgaagccgcccgtgagttatacgagcaaatgggttctgtctatcgtaatctaccaagttggagtaagtatattttaactagtgacttggagtttgaaaaatcttacggtgaaaaagcgacaaaacgacgcaaactatataatggggcattgcgtgtcgattacttccagtactggggtaagcgtgttagataaaaaacaagggatcaatgatctcttgtttttttattttcagggtgactatttatgcaatatgaccaatgataaattttttctttgtacaatattttcgtgaaaaaataattcatcattgttagaataaagcaacaatgaaatgaggattcaatatgattaagtcaaagttagaacaagtcggtatttttaatgataatttagataaagtaaagcctagcccaatccattcattcgacgaaaaagttagtgatattcccaatatcctgaaactaacaattggtgagccagatttttcagttccccagcatattaaagaagctgctttagctgcaattagtgcagatgattcacactattcagtttcagcaggaaagaaaacactacgtcaagcagctagtgactttttaaatgatcgttatggacttgattttgacccagctgaagaaatcattacaacagttggtgccacagaaggtctttatacattattggcagcaattttgaatcctgatgataaggttctgatcccgacgcccgcctaccctgtgtatgctgaaatgacacgcattaatggtgggcacccagtgtttattgacgtttcggaagacgaattcgtattaacgccagatcatttacgcgaaattattgctaccgaagaccatatcaaagcaatcattatcaccaatccttctaatccaactggcgtgacctacacagcagaacagttgaaagctttagcagacgtggtacgagaaacagatattttaatcatttcagacgaaatctattctgaattgagctatgatgcacctcatgtttcaatggcaagaattttaccagaacaaacaattgttgttaatggcgtatcaaagtcccatgccatgacgggctatcgaatcggtattttggcgggtcctgcggcattaatgaagaaaattaatatggtgcatggttttgtcataatgacaccttcaaatcctgcaatggcagcggctactgaagcatttaaaagttctgaaagtaaggacgatacattatggatgaaagagcaatataaaaaacgacgtgactacttagttgaaaaaatgacaaaactaggttttgaaatggcaacaccaagcggcgcattttatatgtttgctaaaatacctgtagatttaaatcaaaatgacgtggagtttgcttatgacttggtagataggcaacagttggcagtcgttcctggatctggatttggaccaggtggtgcaggatatgtacgaattagttatgcggcatctctggacatgctagagacagctatgaatcgtttggaaagttactgtgaagaaaagagaacggtaaaaattttatgattgtcctattataatttttatgataaaataaattatttctaattataaggacgggaatatgacatcagtttatatgcgacgggcgcatgaggaggatataaaatcaattgtatcaatcatcaataatgcccgttattacctgaaagaacaagggctttcacagtggcaatcgggatatcctaatcaagatacgattgaggaagacttagtactgcaaagaggattcgtgttggttgtggatcatcaagttgcgggatatacagcaatattagcaggtgaagacccgatatatacgctgatagaggacggtcaatggctaaatgatgaaacagattacattggcattcatcgctttgctatccttgataagtaccgggggcaaaaactggcgcagcgattcataactgctattttgacatttttctatgaaaacggtacaagcgattttcgaattgatactcatccaggtaacttgccaatgcaagctgttatcacgggtaatggatttgagaagcgtggcattgtgcacattaatgagggagaagaaattaatggtgttcggtgggcgtaccaacttgtattgtaaacaattaaaaaacgcgaactttaatggttcgcgttttttaatgcttgcaaagctaaattatgagctccacgattttctttttctggaacccaattgatcaaaactagagggtatggtgttaattgtagattgatttcatcaacaagcccttggtagtgttttgcataagatttatgcaaggcatcagttacgatttttgaatcactatatatttgtacattttcattgctaggtaggtactttaatgcccaaagaactgccaaaaattcagcctcatgattattaacagtctctctcaaggctgtttttagctgtttttgtactttatcaataattaaaactgcgccagctgacgaacgaccagtagatacgtcacgtgctgcgtcaacatatagtgtaatcatataagtttccttttaattgaacgtataccgaaagtataacaaattttgttgaaatattatatgttgtcgtcgaataatacattgaggataataagctatgcattgttagcagtaactttttacattcctttaattgaaatctggtaaaatattagttgaatacgtttacagaaaagggcaacacatgataccaagacgcggtttttttcaaccactggattcaacaggtacaattagttggttgtggtggggtatattttttatgggcagtattgtcgtttgggatgaaatgagtttcaaacttgaaatcctaccaattttgtttattatggtgatgattttattaggcgtactattagtcgttcgtcgacgtgtttacatcgctgggcctaatctttttttgggccgggtgttattatcagagtatgaaaaaatttctttgaaagatattgaacattggcagttgaatggtcatgttttatcatttgttcgtgctgaccgagaacgaaaatattatcttacaaaaaacattgtgcaacaaattaaggattacatggatactgatggcaaataaaatattaattcatataacagatcaagctgggcgtgttgatgctgtgttatcgaaagaaaatctgagttactcacgtaccacactctcaaattggctagtggatggtacgattttagttaataatcataaagtaaaacgctcatataaagttgtcagtggagatacaatatctattactccacctgagactcaagaaacaaagatcgaagctgaaaacattccgcttgatattatttatgaagatgatgatattattgttgtaaataagccacaaggaatggtcgtgcaccctgctgcaggacatagttctggtacattggtgaacgcattacttcatcattcaccattgtcaaccatcaatggtgaattccgacctggaatagtacatcgcattgatcgtgataccagcggcctactaatggtcgcaaaaaacgataaggctcatcgttcactatctgaacagttaaaatctcataaaaatcagcgcgtgtattacgcgctagtccgtggtgaatttacggaagattcaggaacaattgaagctccgattggacgtcataaaattgatcgaaaaaaacaagcagttattgaaggcggacgtgaggctgtcacgcattttcgtgtcttaaaacgatatgttggttatacgctgttaaaagtgagtttagaaactggcagaacgcaccaaataagggtgcatatgagttacattggtcatccagttgttggggatccggtatacggcacggcacagaagctagatggtacacagttgaatgggcaattattgcatgctaagacactgactttagagcaacctacaacaggcgatgaactgtcatttgacagtccattaccagattactttcagtttgctttatcaacattaacaccgattaatagagaggaagatgaatatgccaaataaagaagttttagataatgcctcattacagcgcgcgttaactcgtattacatacgagataattgagcgtaataagggcggtaaaaatttggttctggtgggaatcaaaacacgtggcgagtatcttgcacgccgtattgcagatcgtttagaacaattagaaggcgttcaaattccggtcatggccattgacattactaactttcgggatgataaacctgatcagcataacgatttaggtttgaactcagaagagcgattgaacatttccgaacagaatattgttttgattgacgatgtattgtttacaggacgaactattcgagcagcattggatgcactgattcatattggtcgtcctaaaacgatttcactagctgttttggtggatcgtggacacagagaattgcctattcgagcagactttgttggaaaaaatattcccaccgcacagaatgaaaagattaaagtctttgtgcaagaaattgatgggaaagatgcagttgaaattgttcattaataactttttggtggctaaggatcaattgatatatttgtggggaagtagataacagataatctgttactttaatgctgcatacaatactgtctatttgtatacagcagtttggagaattatagcttatgattagacatttaatcctagaagatggcacggtttttgagggccttggctttggtgcacctgccaccacttttggggaaatcatttttcatacggccatgactggatatcaagaaattatcacagatccaatttacgatgggcaaatgattgtcttttcgatgcctgttatcggggcagcgggtattcatgctgaggcttatgaatcagtgaaaccaatgataagaggaatgatcgtacatgatttggctgaggtatcagttaatcggcaacgtcgtatgaatttagatcgtttcctgaagcaacacaatattcctggattgtatcaagttgatacacgaaaattgatcagacatttgcgagaaactgggccacaaaaagctacaattgttgactacgctgatgatcacgcagtagatcaattagtagcgacagttttaacaaataaacaagtccaaaatacagcgacctctaagccatatgctaatcccgggcgtggtcgtcatattgtagtaatagattttggtttaaaacatggtattcttcgcatgttaggggattacgatgccaatgtttccgttttaccatatacaacaagcgttgatgaagtattaaccttagatccagatggcattatcctatctacaggccctggcgatccgcgctcactgccagaaagtgttcttacgttgatcagagtattgcaaacaaaggcgccgttactgggtattggcttgggccatgaattatttgctttagccaatgatgcaacattggtggcactcccatctgaacatcacggcatgaaccatcctattcaagaaattatttctaggcaaattttttatgcaatgcagggccaagggtatgcggttgacgaagaattacttgaccataagaaattatttgttacctatcgtgatttagtagatggtgctgtacagggactgcgtcaccgtgattatccagcttttagtgtacagttttttccagatgccgctccaggaccatatgaagcgacagcagtatttgcagatttttttgaaacggtagaagattatgtcgaacatcacagctaaaaatattttattcattggtgcgggatcaaatgattttggtcttgaatcggagcatgatgcagccatttatcaggtcatgcccgaattaaagggacatggtattaatgtctttctaattgacgaaaacccttacgcattgtctctagaaagtttagcggctgaaacaatttggaagcctttgacagttgaaaacgttaaacaggttattaagcataaccatattgacacggtgctaccactttttggtggcgtgcgcgcggtaaggttatgggcagatgttgtgcaatcatgggagcatggggacggtttagtacctcaaactcttggcttgagcattgatatgttactaaggattaataatctggctgattttacgaaatttatggcagaagctggtttaccagttatcacaagccatgttgtcaaagcgcaagacgatgcaaacgaattgttacgtgagcttcaggtcccattaatgattagatctctgcatccaaaaaatactaatacacgtcagatggttgagcggttagatgaatttgaagaagcaattgataatgccaaaacacagtcaatgacgcaagaaatcattatttctaaagccataaatggtttgaaagaaattggaatggaagtgttacgagattttcgcgggaacaagatgaaaatcggtgccagtgaggatatggatccaattggtattcatactgctgattcattaagtgtgtcaccaacattaacgattcaagaccaaattttggaaaaaatgaggatgtatgccttccaagttgctgatttattagaactacaaggtgtaatgcacgttcaatttgcctttgacgatacgacaggtgctatttatatcattaaggtttcaccctatattgatcaaatgtctagtcgtatggcgcttgtaactggatatccagtaatgctagtagccattaacttggcgatgggtattgcgttagaagacattgtgctttcacacgattttggtcaaaaaatggctatgatggaaccgatgatggatcatatcacggtaaagttgccaatttttccattcggtgagttagaggaatccaatgtttcggtgaatcgacagctgaatagtatacaaaagtctgttggctcgacgattgggtttgggcgtacattcattgaggctctcgaaaaagccattcgatcggcacattttaacaatgccacattttcaccaacaaatatggcacatgttagtgatgacgcattaatccagcagctaattcatcctgaagataatcgtgtgttgctactcattgaagccataaaacgtggttacgaaattgacgagttagccgaattaacaaatattgacgaattttacttttatcaattaaggcatctattgcaattagaacttgagattgaaaaagatgtagacagtatcgtgtcattgcggcgtggtaaaaggtatggcttatcagatggtctaattgctcttttttgggataccgattttaaaattattcgagccttaacaaaggaacacaacattgacccaacttataaagctttagaaccatcggccggtgagtttccagagaacgcacgtcaatattactcgacttacgaagaagaaaatgaatctgaacaggtcagtgataatactgttctggtcatcggtagtggtgcctttagactaggggatgctgcatctggtggttatgcgacaaccgttgtgttatctgaactacgacgtctgcagtaccatactgtaattatgaataataacgctagtgatgcaacgctgatgcaaaatttggctgataagcaatatttggagccattggaaatttcagacgtcatgaaggttgttgaactcgaaaatccgatagccataattattccagggaatcgacgtaagttaattacggcattacgcgaactcaatcagaacgtgttgattttgccaaaggaaaagcatacaccaagtggaccggaaacaacacaaactgaatttgccttaaacgtattttctgatgggcatcaaatttatccaattaacatcacccaacacatggtcggtgaaatgcggattgtgccacaaattgttgatttgccaaaagaactaacacaaacacatttggaaaatccaggcgtgtaccaggtaatatggtgtcaaaatggtaatgactgggtagatcatgttgaagtctcaaacatcagttatgatacatggttacgtcctatgccatttggacaagttgcctttataagcaaagtaatgcaggttcagtggctacgtatgacagttcgatcattgttagatcggatgacggagcaagatagaaagttattggataatgttaataaattgacactacaaacagatgtccgcttagtggcttccaatattgattatgagctccacttgcaacccacagagcctattgacggtacaagatttgaattaggggtgggcatcaaatattatgagtaaagacaagtatgaaacacatatgtttacaggtattgtagttgagcaggatctgtcaggaaactatattcctaaagatggcgcgactttgcacaggtggcgaactggaaaacatacaaaaggaaagtacaaacatactgggcaagtatttttgacagaaaataatcaaagtgttgctgtactatcacaagaaaaattatcttttaataagcgccatgattatgtgccgttacaaagatggacagaagcaactgttgacttgagaaaacttgaagcatacaaaaaggatgaatcataaagttcatcctttttgtatgcttattttctcaaagatttggtgttaaagttaaacaggatagcattcaatacgattaacaaagcactgaaaataaaaatacctcgataatcaaatacactggctactagggcaccaaacattggacccatgacacttccgattgattggaaactttgattatagctgaagattcggccagtcattgctgagggtgagtttttagatagcaaggtctgcacagctggtaacatggtggcatcactaataccaataataaatcgaaataccattagcatgaagacacttgttacaaatgctgttgggactaatgcagcgatagcaatacaaaaaccaatttttatcattctgtgtgtacccacgcggtcaccaatttttccaaactgtggcgctgcaaaaactgttgcaataccaggcattgctgccacgacaccggcgagaaaggtagtgttgttactgttgtttgttaactcacggacaaacagactgataatgggattgatggaggtattgactgtttgtactaacattgtagtaataaatagtccaaaaattaattgtttgtttggtagtgcatgccagagatcagctgttgacgttggatttgaatcagcaggggctacgtgaggctcctctttaacaaaaaacatggtcagtatgaataccaaaaataaaatgataccggtgatatgaaaagacatacgatatgaaacaactgaagctaaagtaccaccaaatagtggaccaagtaaattaccagctgtcataccagttaccaaaatgccaagtgcgtgaccggcgtgttctttcggggtttgtgtggcaattaaggcatttgaattggaaatatagccgcccgtagcaccttgaagggcacgaagaatgaataattgccaaacattagtgacataccccattaaaaataggacaatcgccataccaagtgcagcacgaagcatcattaatttgcgaccttttctatcagcgagcttcccccataaaggggacacgatcgccataactaaaaatgacacagagaaaattgccccagaataaaatgttagctgatttttactaaaatggcctaaggtgtcaatgtacaaagaaagaaatggcatgacttcactcagagcgattcctgtcataaacacaccaaaccaaaggaccaatacgttacgtttccaaagagatttttcttgattttttgacatgactaagcacgttatctccctatttttaaataattaaacaagtaaagtttattatttaattttagcgcttatgactcactcgtgcacagatttaaacgtggcttgtgaaaaaattaaattttgcttataatgagagtacgcattgtaaagcgttaataaggtgcaaatcgttttgttaagtgattttgtactctccggaatccatgaagggaattgtgtgcgacatctttgaaatcagtggatctagcttgcttaagacagtagtgtatcaaacactgaaacattgataaatggtcacacattatacgctaaaatatggcaaaaacaaagcattatacaggaccggaagtcctcgagatggtcggacaatacatgtccgaatcagatacaaaaaatgttaaaaaggcctacgaatgggcgtcagagttgcacaaggaacagaaacgtaagtctggggaaccatatattattcatccaattcaagttgctggtattttggcagaactgaagatggatacggcaacggttatttcaggctatcttcatgatgttgttgaggatacgacggctacgttacaggatgttcgagataattttggagaaacaattgcccaaattattgatggtgtaacgaaaattagtaaaattcaatatcaaagttcacaagaacagcttgcagaaaaccatcgtaagttgcttttagctatgtcaaaagacatacgtgtgattattgttaagttagccgaccgtttgcacaatatgcgcactttaggcgctttacgggaagaaaaacaaaagcgtattgcaaaagaaacattggaaatctacgcgccactggctgaccgccttggtattagtacgattaagtgggaacttgaagacttatccttaagttatattgatcccgagcaatattatcatattgcttcactgatgaatatgaagcgcgaagaacgaattagctacgtacaggaagcagtagaccagattaatggtgcgataaaagatcttgaattaagtcatgttgatgtgtatggtcgtccaaagcatatttactcaatttatcgaaaaatggtggataagcataaggcttttgaagaaatttatgatttattggctgttcgcgtattaacggattcgattccggacacttatgctgtattaggagcaatacactcaaaatggacaccgattcctggccgttttaaagattatattgcattgccaaaagcgaacggatatcaaagtttacataccacagttattggtcctgacggacgtccattggaagtgcaaattcgtacgcatcatatgcatgaagtggctgaatatggagtagctgcacattgggcatataaaaaaaatcggggctcaaataaagaggcaaatgtcgatgataacagtcagcaagccttaaatgtcatccaaggcatattagaactgcaagaaaatgccaaaaatgctgaagactttatggatggtgtaacgggtgatttgttttctgatcgtgtttatgcgtttacacctcgtggtgatgtgttcgaactggctaaaggtgccggaccgttggatatggcgttttcaatccatacaaatattgggattaaaacaactggtgcaaaaataaatggtcgaatcgtaccactggattataaaataaaaaccggtgatattatagaaattatcacttctgctaatgctaaaccaagccgtgactggttagagattgtttcgacacgccgagcacgaaacaaaattaagcagtattttaagcagttggacagagaagacaacatcgccgcagcacgagaattgttagctaaaaacctaagagacaataatttcaatcctgctgagattctgacgccagaaaatattcaagaaaccgcagataagatgcactatcatacggcagatgatatgttggcagcaataggatttggcgatattgctgtacctggtgtggctaataaattaaccgaaaagatacgcgaggctaatgaggaagctgctacagcggaattacagcgtgaaatgctggaggaaggccacgaaatcactcgtgatgaaacagctttcaccaaacgacaaaaatcaacggctgatgatattgttattgcaggagtggataatttattagtacgtttaggtcgatgttgtacaccagttccaggagacgatgttaaaggttatatcacgaagggacgtggtatttctgttcatcgtgtggggtgcccaaatattcgagccgctcaacttcaaggacaacgtcttgtggatgtacagtgggaagatgaaaatggctcaaaacctaattatgatgctgatttgactgttcatggtgaaaatcgcggtggattgctaaacgatgtacttcgtagtgttaatggacgaacgcgctatgttaattctgttaacggtcatgtgacaaaaaacgggatggcgcaagtttctctatcaataggtgtcaaaaattcagaacagctgacagcaattatggattctctaaacaatttaccagcagtatacgatgtggaacgcacatttcattaaaatatgtcaaaatatgttgataagcctcaaataaaacaatttcgaggctttttatgataaaaattgtgtcaaaactggaagacgtttgaaagttcttgatacgatatcgtttttcacgtatgatgttagcaagtaaatgtatttttagaatggagatagcatgaaagttgtattgcaacgcgtaagcaaagctagtgttaaaattgacgaccaagtaaaaggagcaattaacaaaggatatgtattgttagttggcgttgctgacggtgacgagcaagcagatatagattatttagttcggaaaatacataatttacgaatttttgaagatgaaagcggccggatgaatcgtagtatcgaagacgtttctggcgctattttatctatctcacaatttacgttgtttgctgatactaaaaaaggaaatcgtccaagttttaccaaggcaggggcaccagaatttgcgactgttatgtataatcaattcaatgcgacattaagggaaagtggattacaggttgaaactggagaatttggagcggatatgcaagttagcttaacaaacgatggaccggtgacaattttattcgatacaaaaagcgctcaatgagcgcttttcttgtggttataataccagccaaatggtatagtactttctgtaccatttctgattcgggaaatatttgtacgatggcggtagaaaacaaaaattgttagtatggtagcaactatcgttagtatccaatcatgatagtatagtgatattaggacggcgcatgagaaactaatcatagagctcagagataccattgaactaattgacaataaaataacgaaaatactaatgatgatgatgaaaaatatgggattataggcaagtaatacaccagctgaagtagcaactgctttaccacctttaaagccaatccagatggagaacgtgtgtcccagtatagcaccaatacccactaacattggattaatgctactatggaacaataagggaagcaagcctgctgccgtacctttaagcatatcaagtgccagcacagttatgccagctcggatacccaaaacacggaatgaattggtagtaccaatgttacctgacccctcatcgcgaatatctttatggtaaaagattttacctacccaaaatcctgggactagagatccgatcaagtaagagagtataaacattaatatagtagtaaacataaaaaacccctttaatataaaagcaagtacaagtttaccatatatttaagtagtatatggcataacttattgaaaataaaatattgacacttgtcagaaacaagattttcatctatgataaaatagattgacattagcgcacgaacactggttcgtgtatcgaaggatagattaatatgccagaaaaaaatcattatgattcagattcaataaaaattttagaaggacttgaggccgttcgtaaacgtccaggaatgtatatcggttcaacagatggtcgtggtttgcaccacttggtctatgaaatcgttgacaatgctgtcgatgaagcacttggtggctatggaaatgaaattcgcgttacgatacatgataataacgctattaccgtacaagactttggccgtgggatgccaattggcatgcatgagtctggtaaacccacaccagaagttattttaacagttttacatgccggcggaaagtttgggcagggtggctatgcgacttccggtgggttacacggtgttggttcttctgttgttaatgcattgtcggagagcttaacggtaaccattgttcgcgaaggccataagtggcaagaagaattcgtgaatggtggtaatccagttggtaccttacgagatttaggtaaaactaaggaaccaacagggacaacggttactttcaagccagatgcgacaatttttagtgctacggtttataaatttgatattttagcagaacgtttgcgtgaatcgtcattcttaatgagtggtgttaagtttacgttaaccgacgaaagagttgatccagttcgtgttgaagaatatcattatgaaaaaggtcttgaagcgtttgttggttttctgaatgaagacaaagaaactatcggaccagttatgacctttgagggtgaacaagagagtattgttgttgatgttgcagcgcagtacaatgatggttactctgaaacacttctttcatttgttaacaatgtccgtacacaggatggtggaacccacgaagtcggtttccgaactgcgtggacaaaggcttttaatgaatatgcacgaaaagtgaacttactaaaagataaagataaaaacttagaaggcacggatgtccgtgaaggattatcagctgttatttcattgcgtgttccagaacagtttttgcagtttgaaggacagaccaaagataaactaggaacgccagaggcacgtggtattgttgactctgtggttaatgaaactcttggacgcttcttaatggaaaatggtgacttcggacaaaacttaatccgtaaggcactgcgcgcgcgcgaagctcgagaagcagctcgtcgcgcccgcgacgaaagtcgcactggtaaaactaaaggggcgaaagatcgtctgctttccgggaagttagcacctgcccaatctaaaaatgctgataaaaatgagctctttctagtcgagggtgattcagctgggggctctgcaaagcaaggtcgtgaccgtaagttccaagccattttgccgctacgtggaaaagtactaaatactgaaaaagctaagttagcagatattttaaaaaacgaagaaatatcaacattgatttatgccattggtggcggtgttggaactgattttaaagttgaagatgcttcatttaacaaaattatcattatgacagatgccgatgatgatggcgcgcacattcaaaccttactactaacattcttttataagtatatgcggccattaattgaagctgggcgtgtctatatagccttaccaccattataccgcgtcaagtactcttccaagaaaatagaagaccaatttgcttggactaatgatgagttagaatcaattacgagtcagagtgatgcacgttatgaattaacacggttcaagggacttggtgagatgaatgcgccattattatgggaaacgacaatggatcccgaatcaagaacattaatacgtgttaaaattgatgacgctgtgttagctgaaaaacgtgtcactacattgatgggtgataaagttgatccgcggcgtgaatggattgaagccaatgttcactttacattggatgaagccgggtcaattctagacacagttgatggggatgacacaaagtctagtgatgtttttgaaaaagcgcgcaatcaagaaactggtacaaaatttaaagaacaaaaaaatgtgccagtcattaagacttggcagaatggtgacgactgatttcacttgttactagataagaatagctagctattcaaattatggttaggttattacttaatattttaaataaaactttttatgacatttatctgtaattagtaattttatagatgttttaatcaaggagaaccgcacttagatggcagatcgtataaccgaactctcacttgaagcagtgatgggggagcgctttgggcgctattcaaaatatataattcaagaacgtgctttgccagacattcgagacggattgaagccagtgcaacggcgtattttgtttgcaatggatcaggatggaaacacttatgatcatccatatcgtaaatcagcaaaatctgttggtaacgtaatgggtaattttcatccgcacggtgattcatcaatttatgaagccatggtacgtttatcgcaggattggaaagttcgtgagccgttgatagacatgaacggtaataatggttcagtggacaatgatccggctgcagcaatgcgttatactgaagcgcgattgtctaaaattgctggtgaaatgatggcggatttgggtcaagaaaccgtggacatggttttgaactttgatgacacaacttatgagccaacagttttaccttctcgtattcctagtctttttattaacggcgcaactggtatttcggcgggatatgcaacagaaattccgccccataatttgaaagaaatcaatgccgcattaatctacttactcgatcatccagccgctactttatcgcaattaatgcgctatgtaaaaggccctgattttccgactggtggtattgttcagggacttgatggtataaaaaaagcgtacaaaactggacgtggtaaaatcgttgttcgtgctaagacagaaatatctgatcttcgcgctggcaagaagaaaattgaaattactgaactgccttatgaggttgttaagtcaaatttggtatcaaaaattgatgccattcgattaaataaagaagtaaccggcattttagaagtccgcgatgaatccgatcgcgagggaatgtctattgttattgaattatctaaagaagcaaatgccaatggtattttgacttatttgttcaaaaaaactgatttgcagatatcttataacttcaatatggttgctattcatgatcaacgaccagtacacgttggtttgaaggctggtttagaagctttcctttcgttccgaaaagaggttgtattaaagcgatcagcatatgaattggctaaagcacaagcacggcaacatattgttgaaggcttaatccgcatgctgtctatattggatgaagtcgttgctaccattcgagcatctaagaatcgtaaagacgctacacaaaacttaattaatcgttttgagtttacacaagcacaagctgaagccattgtcacgttgcaattgtatcgattgaccaacacagatgtgacgcaattagaagaagaattttcccagttgaatgataaaattaatcgtttgaaccaaattattcacgaagagtcagcattgaaagatgttattcgcgaagaaattaaggcaattactaaggcctattcttcaccacgtcgcagtgttattgaagcagaagttgagaatttggtaattgatacagcggtaacgattgctgaagaagatgttcaagtgttagtgtcacgtaatggttactataagcgtgcatctttgcgttcctttaaagcttcggataatgaaaatggtctggcagaagatgatctagttgttttccaaggaaccctaaatacgacaaatcatttgtttatgtttaccaacaaggggaatgttatttatcgaccggttcatgaactacctgatacaaaatggaaagatacaggagaacatttttcacagcaactatcgaactgggataaagacgaagtggtgattaaagctatcgctgttgataatctcgaacaaggtggcgcatttacaatagtttcaaatgacggatttattaaacaaactactttagtagatattgttcccaaagcttataaaaagaaatcttcgatggctattaagcttaaaaaagatgtgagctacgttgttaatgttgcgtacttccaaaatgttaagcgccaaaatgtgctattgttgtcacataatggtgttggtttacgatacgcgataaaagaggtgccagaaattggttcccgtacctctggagtcaaggcaatggacttacgcgatgatgacacgattaaagctgccttgtttattaccgatgataaacaaagtgttgctattgttgctgaaaatggcgccttcaagtatatgccagtatcgttaattaaccattcaaaacgtggtaataaaggtgttctcattttcacacaaaagaaaactgtagcctataaagttgccacagcgacaatatttgatagcaatgtgaaagcactttctattttgacaaagcgttatcaaattcaagaattacaattaagtgattatcatgaatcacaacgtattggcaatggacaatatgtcgttgacactgataaaaatggcgaaccgtggattataaaaccgctaacaatttctgagacaaaatgattaatttttgttaaaataaaaatataaaatgctaggagataaactaatggctaagactttagtttttgggcacaagaacccagatacagatacaatcgcatcagcaatcgctgcaagttatttattgaaccaacaaggtcaggatacagaagcagtcgcgcaaggtgagcccaacgctgaaacgcaattcgcgttagattattttaaagttaagccgcttcgtgtaatttctgaggccgatacagaaacagttgttttagttgaccataatgaagctgcacaatcagttgataatttagctgacgttaccgtggaaaatatttatgatcatcataagtttgcgttcacaaattctacacccttgtatatcacggctaagccatggggctctgtagcaactattttgtactatgaattcaaacaagcaaacattgttattcctgcagaaattgctggtctattagcttcagcaattatatctgacacattattgctcaagagtccaacgacgacatcatacgaccaacccgctttggaatccttagctaagattgcaggacttgaagattatgctgcctatggtttggatttgttgaaagctggaacagatttgtcatcacgcactgataaagaattaattgatggtgatgccaaatcatttgaaatgggcgggcaccaattccggattggtcaagtcaacactgttgatattgatgaagtattatctcgtcaggcaggaattgaagcagcaattgcagaggaaggttatgaagactttttgtttgtgattactgatatcttgaattcaaactctaagggcttgtacattggagatgctgctcaatcaatcgaagcagcatttaatcaaaaacttgacaataatgtaattgatctacctggtgttgtttctagaaagaagcaagtagttccaccattagaaaaccaactctaaaaaaattcataccaaattaatttaattcgaattatgaatttttgtggataaaatgttgataaatttattcacagacctttacactggtaatcggttcatgtataatagatatttgtattgacaagcaaataaaaattttaagaaaaacactaaggagcaaggattatgcgtatccacgtcgttctaggaaatgatgaaactggtgagcgtatctacttgacgtctaaaaaccgtcgtaatacgcctgaccgccttgagttaaagaagtactcaccaaaacttcgcaaagtagtaacatttaaggagattaagtaatggcaaagaagtcaaagattgctaaggcacaaaagcgtgaagctttagttgcaaagtacgctgacaagcgtgcagcattgaaggctgcgggtgactatattggattggcagctttgccaaaggattcatctccagtacgcgttcataaccgcgattggattgatggccgtccacacgcttacatgcgtgaatttggaatgtcacgtttgaacttccgtcaattagcacacaagggtcaaattcctggtgttcgtaaggcttcttggtaaaagaaaccagcaactttttctaattgtttcattcgaaggattagtataaaaaagccccagcttgcgggcttttttatgttgttgacgtatgtgcactgtaatttgcactattttaataaatagggtacaataaatatagttaatttacatagcaattgtaaatgggcgggtcacttggaaaagcggccggctcattttttatgggattagcacgcttattgtcaatataagatagtgttaacgctatattagtaaacgtaattgacaaaactattcatcgaaaggggaaaataaatggcaaacaaaaccgaacagacagttattgacttgatttcaccaatcattgaagcacataatgatttactgtgggatttaacgtttaccaaagaaggtggacaaaaagttttacggattttgctggataaacctgatcatcaatttattacgatgaatgatttgacactattcacgcaagaagttaatgaattgttagataccgtggatccagatccaattcctgaagcctatgttttagatatttcatcaccaggcgctgatcgaccattaaaggaactatggcattttgagtgggctaaagaggccaatgaaaatattttagtatccttgtttgttgccaaagaaggccaaaaaaagtggcaaggaaagattgctgatctaaacaaagatggcttgacgctgacgacaactaatggacgtttgccattaacctttgacgaaatagctaaagcaatactggatgtccagttttaaatcgttaaaaatggagaaaatcaaatgagtaaagaattagtggaagcacttaatgctcttgaatcagaacgaggaattgatcgtttagttgttgtcgaagcgcttgaagacgcattgaaagccgcctacaagaagcaatacaataccgctgataatgtcgaagcaacattcgacgataaaaagggcaacattagtattaaacaagtaaagcatgttgttttagatgatgatcttgaagatgaagaaatagagatttctttatccgatgcattggcaatcaatcgagcatatgaagcaggagatgagattcgctttgatgttacgccaaaagattttggtcgtatggcggcacaagctgcaaaacaagtgattgtgcaaaaaatgcgtgaagctggacgacaagctatttataacaagttttctgattatgaagatgaaattataacaggtgaagttgaccgacaagatgcacgattcctatatgtgaacttacctggaaatcaagaagctgtaatggccccaaacgatcaaatgcccaatgagcggtatcacatgggagatcgtattaaggtcttggttaacaaagttgaaaacaatgccaagggaccacaagtctttgtatcacgaacagcagctgatttggttaaacgattgtttgaacaagaggtgccagaagtttatgatggtactgttgaaatcatgtctattgcgcgtgaggctggtgatcgctcaaaaattgccgtttatacgcatgatactgacttagatccagttggggccatggttggtcaacgtggtgcacgtgtacaaagcgttgttaacgaactagctggtgaaaatatggatattgtggagtgggttgaagatgaagcacagtatattgcgaatgctttaaacccttcagaagtaactgatgtcatttttgatccagccaacgaccgtgcggtaacggttattgttccagataatcagttatctctagcaatcgggaaaaagggtcaaaatgctcgcttagcagcacgtttaacgggattcaagattgacattaaatctgaaagtgaagcagcagctagcttagacccaacaccagctgctacagctgctgacgaaaacgaagaataatttgaaaggaaatatgatcataaatcaagtgatttatagtcatactggtacatatgaaacctcgtaaaataccaatgagaaaagacattgtaacgggtgaaatgtttcctaaaaaagaactcgttcgagtcgtgcgtagtaaagaaggtgacgtgactttagacccaacagggaaagccaatggtcgtggtgcgtatgttagcctaaatgtaaaaaatgcagaaatggctaaagaaaagcgtatctttgataaagcatttggtgtgaaagtagcagatgaattctatgatgaactcattgcttacgttgaccatcaacaagcacgtcgggagttgtttggtgataaataagaatgaccaaatattgaatttagttggtttagcaatgcgcgctggtaaactagtacttggaacagaacctacgttatcagctattcgtgggcaaaaggtttttctagttttctttcccagtgatggtggtaaaagccaggcaaaaaaattcgccgataaatcaaacttctataatatcaaactagtacaagactatactaaaaagcaattaacggatgccattggtgttaaccgaggtgttttcgccattgctgatcaaggttttagtcgaaaaattaaacaattaatttcagaaaaggagcggaactaaatgacagaagaaaagaaattctcaggttcaaaccgtcctgcacgaaaacaggcagtcccagaacgtaaggaattgcccgcatcacaacgccgtcatgcggcaaagttagcagatggtacaacgccagcccaaggaggctcacgtccaaaccgtcctgcacgtcctaacaataacaatcaaaatcgtccaaataatggtggccaaagccaaaatcgcaataatcagaatcgctcgaatacatctactggtggccaaaaccgttcaaataacggtggaaaccgcaacaatcgtcctggatcacgcgttgcacctgctgaagggcgtccaatgattcgagagaagaaaaattggtcaacgaagccacgtgaagggcaagttgattattctgctaaaccggataatagcttgaagcagtacgtgaatgaaaatgaaaagaagcgccaagcttctgcagctgctaagcatccaaagaagccagctgcagcaactaagccagctgtaaagaaagaaactagtgcaactaaaccagctactgcatcaacaaccactggtgcagggaagtttggtggcgctctcgcttctggtaataattctgcgcgcaataactcacgtaagcgtaatactaatggtactggccaacaaacaccacgccgtaatgatcgtccacgcggttctaaaaagtcacgtcgtattgctgctaaacaccaaccatcaactccagcaacagtacgtaaagaacaaccattaccagcagttttggaatatcgtgttggtatgaacgtgcaagatttgtcaaagttgttgcatcgtgatacagcagaaattattaaaaagttattcttactgggcattgttacaaatcaaaaccaaagtttggatgaagatacaatcgaaattttggcagctgattatggtatcgaagcacaagcaaaagaagaagaagacgttgctgatattgacagattctttgatgatgaaaatattgatgagagcaagttagtttctcgtccaccagttgtgacgatcatgggacacgttgatcatggtaagacaacattgttggattatctacgtaattctcatgttactgaaggtgaagcaggcggtatcacacaacatatcggtgcataccaaacacgtattaatgataaattaattacattcttggatacgccaggacacgccgccttcacagagatgcgtgcacgtggtgctaacgtaactgatttgacaattcttgttgttgctgctgatgacggtgttatgccacagacaattgaagcgattaatcatgctaaggcagcgggaacgccaatcattgttgctgttaacaaaattgacaagcctggagcaaatcctgacgatgtgatgaatcagttaatggcttatgacttagttcctgaagagtatggtggtgacacaatcttcgttaaaatttcagctaagtttggtcaaaatgttgatgaactactggaaatgattttgttgcaagctgaagttttggaattgaaagcaaatcctaatatgccagcacgtggttcagtaattgaagcccgcttggataagggacgtggaccagtttctactgttcttgtacaacaaggaacaatgcatgttggtgatccaattgttgttggtaatacttatggccgtgtacgtacaatgacaaacgaacgtggcgttgagctatcagaagctttgcctgcgacacctatccaaattactggtttgaatggggtgccacaagctggtgatcgtttcattgttatggctgatgaaaagacagctcgcgcagccggtgaagaacgtgcaaagcgagcacaagaagcagttcgtaattcaggatcagttgttactttggatacattattcaatacaatggctgaaaaagcgatgaagacggtgccagttattgtcaaggctgatgttcaaggatctgtcgaagcactttctggatcactgaaaaagattgaggttgacggtgttcgtgtggatattatccatactgctgttggcgcgattaacgaatcggatgttactttggctgaagcatctggtgcaattatcatcggattcaacgttcgtcctacacctttggcaaaatcacaatctgattctgaaaaggttgatattcgtttctataatgtcatttataatgcgatcgacgatgttgaagcagctatgaagggccaacttgaacctgtatacgaagaaaaggttattggaaaagtcgaagttaaagaattattcaaattctctaaggtcggaactattgccggtgccatggttgaagaaggtaaaattactaaggattctaaggttcgcgtcatacgtgataatgtggtagtgtttgacggtgaagttggctcattgcagcgcggtaaagatgcagttaacgaagtgaagatgggatttgaattcggatttacagtggccaaatttaatgatgttcacgctggggacgttgttgaagcctatgtaatggaagaagttaaacctaagtaagagaccgattacgctgaatgctttttggtaggttgtgtcttttaatagaaagaaagagaaggcgaaatagttatggcaaatccacaacgtgcaggtcgtctcgctcaagaagtacaacgtgatgttactgatttattacttaagcgtattaatgatccgcgagtaaaagaggttacagtaacaagtgttgaattgtctggtgacttgcagatagcaacaatttattattccattttatctgatttggccagtgatgctaagaaaactcaagccggcttggaagctgctagtggattgattcgtaaagaattaggttcacgattgacggtttacaaaacgccagaattgaagtttgtgcgtgatacatctgttcaatacggaaatcatattgaggacttgattcgcaagctgcacactgaaaattaataaattatcaaatattgggcgctctccattaggatgagcgctttttgtgttaaaatagttctatacaattaatttttaagaaaatgagatttaatatgactaatccaactcaacccttcaattctatagtattggatatggcgcctgacaaactattggattttcaattaaaagttcgtgatattccagatattttacgattaacatttggtgaacctggttttgctgttgatgaacgtattaagcaagcgactattgatgcaattacaaatgatcgttctcactacgctgaaagtcaaggtgaaacagatttgagaatagctgctgttgcgtattttaatcgtgagtatcatttaaattataatggtccagaaaatattatcatcacacagggtgtgagtgaagccataaatgttatatttcaaaccctcctgaatgataatgatggcttgttggtaccagaaccagcctatggaccttatttttcttctcttgatttagcacatggtgtgcgtttgtccattgatacaacggcaaacgattttaaattaacacctgatatggtcgaagaaaccatcaaaaatgcgacggtacccgttaaagctattttgatgaattacccaactaatcccacgggagtaacatactcacgtgatgagatcattgcattagctgaaacatttacgaagcataatttatgggtcatttctgacgaaatttattccgtcctaacttatgatcaagaacatgtatcatttgctgagtacatacctgaacgcacaatttacattaatggtttatccaaatctcatgccatgacaggctatcgtgtgggatttattttaggccaagctgagacaattgcgcaattgcaaaaaacacatggaacgctggttttcgctgtacccacatttgttcaagatgcggctttggttgctttacgtgatgtaaccgacacaccagtaaagatgcgtgatatttatcgtcaacgtcgagacaaagtgttatcacagttgcaggcgttagggtttgatgtggttgagccagaaggggcattttatttatttgctaaattgcctgctgatttaggtactgatggcgatgtgtttgctttacagttagcaaaagaaggtaaagtggcggttattcctggttcggccttcagcgatgcagcgcaagcttacattcgtatttcatacgctgcgtccgatgaagacttggcaaaaggaatgaagcgaatgacaaaatatattgaaaaggtacgcggctaaagatgaacttctggaaacgactttttggttcagaaaaaaaattatcacaattgaagagtacgggtcaaatcaatgcgactagattagcgcgtaataatgatacgcctgttttagtagcgccagtgactggggatttacaaaaaattaccgacagccgcgatgaaccctttaaaactaaaaacggggttatgttagtgccgcatggtggtaatttaatggcaccggtttcgggtattgttactgagtccactaatgattatttgacgctaacagatatttcagaacagactgtaactgtaactgtcgtgggcacatcaaatgtcgttcggttggctcaatacggtgtaggacaacaattacatgcaggtgatgttattggaacgacaaatcagaaggtgctatctgctgatcatgaagcactacgcatttatgttgtttgggcaaaccaagacctaccaaatattcggtatggttctgtttatgcaggacaaaacgtctggcaagtaggggaattgcaaaatgacaaagaatcagatagttgatggtttgttagttatcaataagcctcgtggcatgacatcttttgatgttgttagtagagtacgccgtattattggtcaaaaaaaagttggccatgctggcactttagatccgaatgttgatggtgtcctagtagttgctttaggtaaagcgacaaagttgattgatgaattgcaaacacggccaaaaagttatattggtgaaattacattagggttttcaacagaaacagaggaccttgatggtgaaatcgttgatcagctggatatcgtaacgcctttttctgaccagaaaattgatcaagcgatacagcaattaaatggcgaaatcacacaaaggccacctatgtactctgctgtaaaagttaatggtaagcggctctatgagtatgctcgaaatggtgagactgttgaacgtccagttcgtaaagcggtaattcatgactttaaacgtacatccggtattaaatttatagatggtaagcaggtattcaagtttgaagccacagtttccaagggcacgtatattcgcactttagccgtagatgcaggcaaaataattgggatcccggcaacaatgacacaattaactcgaacgatggggagcggcttcaaaatttctgaagcacgtgacctggattttttgtccacactatcgtatgaagaagtattaaaacaagtaatacctattagagaagtattgaagtggccaactaaaaatttgagtgaaaatgaatggtttgctgtaaaaaatggtcagaaaatttctagttggcctgcaaatgacagctatttgcaactatattatcaaaacaaactgaaagcagtatatcaatatgacgagattgagcaattatggcgctctcgttatgtatttgataaccaatgactatgacagaattaattcgtttacattatccgatattagattttaaaaagccggttcaacaggtcgttgcaatgggcttttttgacggtgttcatcgcgggcatcaggctgttttagctcgtgcgaaagcagaagctgaaaaacaaggggtgcccttggctgtgttgacctatgatccacatccaattgtagcttttcagacgttgaaaaaaccactgcgttatttaacaccattagccaaaaagaagtccatcatgagccagctaggtattgatcgggtttatgttatgcaatttacttctaaacttgctaaattaggtggtcaacagtttgtagatgaggtggtcatgcaattaaaccctgttacggtggtagcaggattcgaccatttgtatggtgcagcgggaacggatagtgatatgctacatttagcaacatatgcaactaatcgctttgatgttattactgtgtctgaatttgatgattataatcagaaagtttcttcttcaacaattcgatctatgttagatcaggggaacgtagatggcgccgcacagcagcttagtcgtgtccattcgacatcaggtatagtcgtccatggcgaagctagaggccgtgaattaggcttcccaactgccaatatacaaacacctgaagaggaatggctgcctggtattggtatctatgctgtaaaaataaaagtatatgatacttggtatctaggaatggctagcatcggacgcaatgtgacgtttggtgatgctcgtccaatcacagttgaaattaacattttagattatcaagaagaaatatatggtgagtttgttcagatacaatggtgtcattatctgcgtggtgaagtgaaatttgaaaacattcaagcactgatagatcaacttaatgaagatgcaagacaaacaaggcattattttaatacaaaattataaaatacagttttttggcactcttataaaaagagtgctaaaaagacttgcattatttctcaaatagtgtattataataagtgttagcagttagatatagtgagtgctaaaaggagtcgataatatggcgctaacagaacgacaaaagttaatcttaaccgccattatttatgagtatacacagcgtgagcatgcggttggttcaaaaagtctacaagaacatctagatattaaaattagctctgctacgattcgtaatgaaatggcagcgctagaatccgatgatcttataaaaaaattgcatacttctgctggtcgagtaccatcatacgaagggtatcgttattatttagatcacctgatgatgacacgcagagcgactgatcgcgatgtacaagcggtcattcaatcattccgtggaaacttccatgagatagatgatttgctagacgaaacagctaggactttatcaaatttaactggttatactgcgttaattttgaagccaaggcgaattgatattaaagtttcgggatttcgattggttccattggagggccatcagctgattgcagtattggttactaatgatggtaaagtgactagccagacatttaaattaccaaatgaaatggcgattgaatcgttagaaagtatggttgcatacatcaatgatcagatggtcggtcgaccggttaatgatgtgttgcgtatgatgcagtctgatgagttgcctacgcaaatgagtcgcatgattaaaacgccggcagcttttttgcaactatttggcgacgtgttagcacgatcgaacggagataacgtccatattggcggccgattgaatgttctagactttagtaaagaaacagatatcgctgatgtgaagcctctgttggaatttttgaacaatgctgaggatgttagacaaattgcttcgccaacacgagatgttcaagttaaaattggacgtgagattggcgagccattactttcagagttcagcttgattacgcgtggatttttggtaccaaatcaaggaagtggtattattgctttacttggtccaattcctatgtcatatagtaccaatacgttgcttacagacgcgtttggtgaagcgttaagtcgcaaaatgattgaatatacatagctaggaggtcacacttgtgacagaaaaaaacgaagaagttgtagaagataggaacatttctgatcaaactgatgaaaatttgaccgaagaaattgaatctgaagctgatgatttgcaggtggagcctgatccgaaacaagcggaaattgataagctaacagagcaagttaacaacctcgaagaaaaattattacgttcacaagcagaaattcaaaatatacaacagcgtaatgcgcgtgaactacaaaatgtacgcaagtatgatggacaaaaattagccagtgcagtattgccagccgttgataatttggaaagagcccttcaagttgaagctaacgatgaagtgtcaaagcaaattaaaacaggtgtggagatgacacttaagacgttaaatcaagctttaacagacaatggtattacgtcaacgggtgaaattggtgaatcttttgatccaactaagcaccaagcaattcaaagtgttgagtcagatgaagttgaatctgaccagattgcacaagttttgcaaaagggttacatattacaagaccgcgtaattcgaccagcaatggtttcagtggcgaaataagaacgattttgcatggtgattcaatcgatgagataccacaccttaaaaagatgaaaatgattttaaagtaaaggaagaaaatatttatgtcaaaaattattggtattgatttaggaacgacaaactcagctgttgctgtccttgaaggtggcgaaccaaagatcatcacaaatccagatggtggtcgtacaacaccttcagttgtctcatttaaaaatggcgaaagtcaagtgggtgatgttgcaaagcgtcaagcaattacaaacccagacacgattatttcaatcaagtctcacatgggtgaagctggttataaagttaatgccaatggtaaagactacacaccacaagaaatttcagcaatgattttgcaatatattaagggctatgctgaagattacttaggtgaaaaggttgaaaaagctgttatcacagttcctgcctactttaacgacgcacaacgtcaagctactaaggatgccggtaagattgctggtctggaagtagaacgtatcattaacgaaccaacagctgccgcattggcttatggtttggacaagctagataaggatgaaaaaattcttgtctatgacttaggtggtggaacattcgatgtgtcaatccttgaattaggagatggcgtgtttgaagttttgtcaacaaacggtgatactcatcttggtggtgatgactttgataacaaagttattgactatttggcagaacaatttaagtcagaaaatggtgttgatttaaaggatgacaaattagctttgcaacgtttgaaggatgccgcagaatcagctaagaagactttgtcatctgcaaacgaagctcaaattgatttgccatttattgcttcaggtgataacggaccattgcacttgcagacatcattgacacgtgcaaagtttaacgaattaacagctgatttgattaagaaagcagagcaacctgttttgagtgctttgaaggatgccggattgtcattctctgacatcgacgaggttatcttgaacggtggttcaactcgtattccagccgtacaagaatctgttaagaagatgacaggtaaggaacctaaccactcaattaaccctgatgaagctgttgctttgggcgctgccgttcaaggtggtgtcattactggtgatgttaaggatgttgttttgcttgatgttacaccattgtcattgggtattgagacaatgggtggtgtgttcactaagttgattgaacgcaacacaacgattccaacttcaaagtcacaagtattctcaactgcagctgacaatcaaccagctgttgacattcatgttttgcaaggtgaacgttcaatggctgccgacaacaagacattgggtcgattccaattagcagatattccggccgcaccacgtggtgtacctcaaattgaagtgacatttgacattgatcgtaacggtattgttaatgtttctgctaaggacttaggaacacagaaggagcaaaagattacaatccaagctgctggtggtttgtcagacgaagaaattgaaaagatgatgaacgatgccaaggcaaacgaagaggctgatgctaagaagaaagaagctgtcgatacacgcaacgaagctgatcaattgattttccaaactgaaaagactttggaagaagttggtgacaagttgggtgacgatgaaaagaagccaacacaagacgctttggaagctttgaaaaaagctaaggaagatgccgcagctgatgatgctgatttgacagatttgaaggctaagtcagaagaattaactaaggtagctggtgaattagcaatgaagttgtatcaacaagcagcgccaaaggacggagctgaaggagacgcaaagtctgctgatgacaacacagttgatggtgattttgaagaagttgatccaaataaagacgacaagaagtaattattaaaacaaaccgcattcattgagtgcggtttgtgtacataaattagaaggagcgggcgcgtgaataacactgaatattatgaccgtctcggcgttagtaaagacgccagtcaagatgaaattaaaaaggcttatcgtaagctatcaaaaaaataccatccagatttgaatcatgaacctggtgctgaagaaaaatataaagaagttcaagaagcttttgagacgctaggtgatgaacaaaagcgtgcgcaatatgatcaatttggacctaacggcgcacaaggtggttttggtggccaaggcggttttggcggccaaggtggctttagcgacttctccgatttgggtgatatatttagtcaaatgtttggtggcggatttgatccaaatcgtccgcgcaaaggacaagatttacagtaccgcatgaacttgacttttgaagaggccatttttggtaaggaaactacgattaagtttaaccgtggtgatggtaagcaacacgagattaaggttactgtacctgctggtgttgaaactgggcagcaaatgcgtttgagtggacaaggtgaaagtggtgttaatggtggaccacaaggagacttgttcgttgtcttccaagtatcaccatcaagagatggatttgaacgtgatggtgcagatgtctacttagaacaaaagataagctttgtgacagctgcgttgggtgacgaaattcaagtcaagacggttcacggtgaagtgaagttaagaatcccagctggtactcaaactggtaagcgtttccgcttgagtggtaagggtgctccgcgtttgcgtggcaatggacacggagatcaatttgttattgtgactgtcgaagtaccgacacgacttaataaagatcagaaaaaggcgttggaagctttcaaggaagctaccgacggtacaactaagaaaaagagtttcttcgataaattgtaatcaaaaagctccgcagtgattatctgcagagctttttagattgaccaacttaatcaatatattttgtatcttcatcaacttcccaaggcgattgcatattaatgtgatcataatataagtgcccatgtaagtgatcaatttcatgctggaaaacaatggcaggatagtcgcgcaatttaattgtttgcttattaccatcttcatcctggtagcgtactgttattcgataagcacgaggtacaaagccaggcacatcttcatcaactgatagacaaccttcaccaacgtttaaggcacctcgcttgacggactctgaaataattacagggttgaaaatcgtgcccttaaaataaggttcgtcagttgtgccttctgggtcaagtgcaggtattaaaattgatgacatacgcaaagagtagcctacttgtggagcagctaatccaacacctggacgtagaccgtacttctcattttgtttttcatcttgagatacaactaaatattccatcatatctttagcaagttgtgcgtgttcttcactcaaagggaaaggaacggacgcagccgttttacgtagtacgggatccccgtcccgtgtgattttatccatagtaaatctgattgtcattttttttacctcacaatctagtatatcaaacgttataacatgttaaaataaaattatgaatgaaaattatgtattaccaatcgatggtgattggacgacccaagatattattattgtgacaaattttataaacagtgtgttaggtgtttatgaaaaaggatcttctcgtgaagaggtattaaaaaactacgatgcatacagaaaaataatgcctgccaaaagcgagcagaaaaaatttgataaggattttgaacgccaaacgggatacagcatatataaaaccataaaatttgtccaaaattcgacgaaagacagagtacgcttatgagcacattaagcccatttgaaattcaagaaattgaccaaactgtattagtgtggcttgatgaattgcaaaaatctacaatagcggcaatgaatcagcatttagatgtagctactaaacacgatgcacgtgatttagttacaaatgttgataaaagcaatgagcaaataatcaacaagtacattcgaaaatttgatccagatgcacaaattgtgagtgaagagggatttggtgataaaccaattagtatggctggacatgtgtggtttgtcgatccaattgatggtaccatgaatttctataaacagcacgatgactttgctattatgatagcactttacattgataaccaacctattttgggatggattatggatgtggtaaataatattgtttatcatgggggtcctcaaatgggtgtttttgccaatcaattgcggttagatccaccagaaaatgatgcgcttaatcaaggaattgttttattgagtggtgcgcgcttgctctatggaatgtttggatatgatgaaattgctaaaagtgccttgggataccgagttattggcgctgctggtccgtcttttatccgtgtcttacgtggtcaggccgttggatattcttcaaaaatgatgtcatgggattttgctgctggtcaagttttagcaaaaacattaggattaattgtttcagatattgacggaaagcagttagatatgttatcatctaacatagtattagttgctacgaatcgagcgcatcgcgatattttggcgttgcatagaagctagggaacgaagtgtccctagcttttgtatgtggcagcatttaaattaaaggagtactagaaaattggcaaatcgcgaagacattcgtaacatcgctatcattgcccacgtcgatcacgggaagacgacgctggttaacgaacttttgaagcaatcagacacattggattcacgcaaggaattgggtgatcgtgcaatggatactaacgatattgaaaaagaacgtggtatcactatcttgtcaaaaaacacagccgttaaggttggggacaagcaaattaacattttggatacacctggacacgcggacttcggtggtgaagttgaacgtatcatgggtatggttgatggcgttttgttggtcgttgatgcttttgaaggtacaatgccacaaactcgttttgtgttgaaaaaagctttcgaacaacatttgacaccaatcgttatcgttaacaaagtggatcgtcctggtgcacgtcctgaagaagttgttgacgaagtattggatttgtttattgaattaggtgccgatgaagaagatttggacttcccagttatctttgcttcagcgatgaacggtacatcttctttgtcaccaaatgttgacgatcaagaacatacgatgaagccaatttttgatgctgtctttaatacaattccttcaccagttgacaactcagatgaaccattacaattccaagtggcaatgttggattataatgatttcgttggtcgtatcggtatcggccgtgttaagcgcggaacaattaaaattggtgacaacgttgaagttttgaagttggatggttcaacacaaagtttccgtgtaactaagcttgctggtttcatcgggttagaccaagtagatatccaagaagctaaagctggtgatttgattgctgtctctggtatggaagatatctctgttggtgaaacagttgcagatcctgctcatccagatgcattaccaattttacgtatcgacgaacctactttgcaaatgacattccgtcaaaatgacagtccgtttgcaggtaaagaaggtaagtttgttactgcacgtcaaattgaagatcgtttgcgtcgtgaattgcatactgatgtgtcattgcgcgttgaagatattggacaagctggtgcttggtcagtatctggtcgtggtgaattgcacttgtcaattttgattgaaacgatgcgtcgtgaaggctttgagttgcaagcttctcgtccacaggttatttaccgtgaaattgatggtgttcaatcagaaccatatgaatcagttcaaatcgatacacctgatgaatattcatcaacagttattgattcattgaaccaacgtaagggtgagatggtcaacatggagtctgttggtaacggacaaacacgtttgacttatatggcaccttcacgtggcttaattggttactcaactgaatttatgtcagctacacgtggatacggtatctttaaccatacgtatgctgaatatcgtccagttgttcgtaactgggaaccaggacgtcgtaatggggctttggtttctattaaccaaggaacaacttcaaactatgctatcatgggtgttgaagatcgcggacaaatgttcgttggtgctggtgttgaagtttatgaaggaatgattgttggaatgaatgcgcgtgacaatgatatctctgtcaacgtcacaaaattgaagccacaatcaaacgttcgttcatcaaacaaggaccaaactgcttcaattaagacaccacgtatcatgaatttggaagcttctttggaattcttgaatgatgatgaatatgttgaagtaactcctgaaaacgtacgtatccgtaaagctatcttgaacacagctgagcgtgaaaagtctgctaagcgtcgtaaggcatcaacaaactaacatttattttaaataatcaggaacctgcttgggttcttcgttatggagctatggcacaatccggtactgcaacggactcgaaatccgtcgagccgcatttcgcggtgtgcgggttcaaatcccgctagctcctttattatatgttatctcatgttcttatatgtacaaaaacgttgttatctcaacgtttttttattttgcataacttaatacaacgttagaaaacagcacagtacacagtaggagccatttactgttttcgtaactcaaactgcaaaaaaatttatgtagggtttattcttaaaatcattcaatccgaataatttcatcaaaatttgaaaaaaatacttgtttgtgtaaatgattacgactccaattttcgaggacatatcttttgtgttgataattttcaaaaaaatctgataactcgaattttttactttttgatcgtcttaacatttcatccaaaaatgcctagtcggcattttgagtttgcaaagaataatttttccaatccatgaaattctgtccttttttaaatcagtatcattttggcgctagtaattaaaggatatcacaaatatggtatatggggtatgctatataaaaacatagccagatttaaaaaccattaaatgcttacaaagtatttgatagaaagctgctatttcttaaaattgaacagtgattagtagcaaattatctctattcttctaatgttagaaaaattaggtacaaattatggtgaaagttcacttcagaaattattatagaaacttttgctttaaaaacactattacttctgttatgatacataggagcgtgtttcttattttggagatgttaatgaaggttatttcgctcttttttggggaaagtagaatagtatgataaataaagttaagtatataattggtaagcatttaaacataagtgtttgcttactttttgcgttattcagttgtttgattattttaccttatttgcatgggccagcctatatccatcaagagggatgggatgggcgtttccatatggctcgtgtcgcagaaagttatttgaatttaagtcatggtcatttggatcaagcaattcccagtgtgatgactaaaacttttggatcatttggatatccacaaaatcttttttatccgttgataactatgcttccagaggtgctcttgcacataatctttggcaatgcgtacggtggttatttggcatttattgctttaatctttttttcaacgtttatgtcaatgtacatttgtacattaaaaataacaaaaagtcgtttcattgctctattaagtagtgcgctatatggatttagtcattttgcgatttctataacattgttttatcgtagctttggtggatcttttatttttatttttatgccaattgctttttatggaatgtatcagattgcattaaaagatcataaaaaatggtggataatgtctttaggggttgccggactcattttatgtgatctacctgatgcggtagttgttgttttgatgttggtcttttcattctcaatgacatttactgttaaagaagctaagaatattaaattaacgcgtatagtaaagttaatttacgcaggaatgctttcagcgttactttcagcgtttttcttagcaccacttctacaaaatttgttgtttgttaaaaatatttctgtcaataaactattgttgtcaaatactgttttacctacaatgagtgtatttttaacagacaagttggcttcgtacagcttaggtttatcaggcctaatcgttgtattctttgttattaatggctggaacaaatttcatcccgcattaaaatacttatcagtagttttgctgatcaatttaatacttgtaactaatatctttccttggccaatttttgataaatatttagggttcatacaattcgttggcagatttctctatactgcgacttttatttcagcttttcttggggcaattgccattgctaatattgttgaaaatagaaagagtcgctacttgctggtaacgctattttgttctattggattgctctcagtcactagtcttaattttagtattaagcgaaacccaaacggcaatgctgttaaaatagtttcttgggatgattttcaaaatgccacactaaataattatgtatatgattatttgccacataatgcattcaaaatcaaagataagttagaacaacattctattccgttgatgaatccaaagaaagagatacaacaaacacgttggacaacaggatacgacagcatacattatcgaattaattcagtacaaaagtatactgatgttgtattgccaaatatcttttatcctgggttcacagtatacgtgaatggggaaaaaatgcctgaaaaatataataaaaacaatgccatcgttgttcctatagaaaaaggtattagtaaaattgatgtgaaatatgtaaagacgccggttcaaataatttcattttggataagtgtcattgcattgttgactttaattgtattaaaaaataaaaaattgactaagctgttaccattgtttaaaaaacattgaactaattagattatttaactgctttaattttggaggataactatgtcttggatctttttgttgtttgcgggtatttcggaaatattatggtcaactgctatgaagttaagtgatggtttttctaaagtgggttgggctgttattactgtagtaggtctaattactagcatgctttgtcttctgcaagctgttaaacacttatcatttagtctcgcttacccaatatggacaggtattggcgctgttggttcagtccttgtgggggttatcctttttcacgataaattctcaactgctacgtggttttttgttgcattattgattgttgcaattattggaataaagatgacagccggagagtgacaagtggttcccaactgcgttgatggttcaataaaacataattataaagcccttatcagttaagaaagggctttataatttttattttgtgaattaacaaataacttcgtacaatcattggacttgccaatgatagccaacaggtaaagcttctccaggtgctattctagtagaatgacctttcctagtttcccaggtaaagccatcttgtatagcccatttatatcgatcagtagaattgatattattactatcagctgtctgggtggttacagttgaagtatcagtatttgcctgttgtgttgcttcagaactagcttgcgcttgagaagcagcaatacgagatgattgaacaatagattcgctgttagaagctgaactagcggagattgacgaggataaagcggcagattctgaactagatttttcagcatcagatctagctttggcttgagatgatgaagctgcttctatactagcaacctcagcacgggagctcgtttctgcggctattgaaattgatttggattgactggcttcgctgttttcagatgtagaggagctacttatttccgagctagtttgattgctattgctactgctatgatttggtgatgcctcaatcaatagaaatagggcaatgaagattagtccataagtaccttttattttataccaaggagcatggctacgcttctttttaatgtcattgatggaccaaaggccaagccaccaaagtaaaaaaagcggccaaataaataaaagaataatccaaaaaattggttttcgtttccaactgtttaacttattgttgaagtttgcataatctaacattttcaaattctcccaaattctcttcaactttttaacgtggacgcctagcacgtgaaggcagaaaacactagcacctctaattaaaagaagctcttttttgcattatagcaaacatttttagaaaatatgtaaaaaatgttatcaaaaagcatctttgcgattcgtttggaacactttcgcaaagatgcttttttattatgaaactgtttttttcaatttatgatagctattcaaactgccaataataaatacgagtatgccagtccaaataaaagcaaacacaatgaccttatgccagttaaaggcttcatgcaaaacaaaaatggccataagcaattgaatagttggattaagatattgaataaaactcaacgtgataaagtcagtatttttattggcaacagcgaataaaagtaaggggataaccgttaagataccactcataatcaatagaatcgtaatcttaggcccattttgtatcatcacatgtggagataagaacagataaactaaagcaataggtgcaacgaagagggtttccagtgttaatgaaattgtagctggtaagggtacttgttttttgatcaagccatagaaacaaaatgtagccgccattagtagtgtatttaaaggtagtgatccagtttgaatagttaggatgacaacgccaataataacaagtattaaggcgactattttggatcttgatagtttttcatgtaagaaaataactgcgacaactacattcattagtggcattatatagtaagagaggctcgcttcagtggcttgctcatgagtaaccatatcgatatataaaaaccagttaattgagattaggaaggcacttaatataatcaaacccattttgtgattttggattaattcaataatgacgtgccagacttctttccaacttttttgaaaggttaacaccacactaatggttacaagcgaccaaacaattcgataggctaaagtatacattgctgggacaacacttaatagttcccagaacacaccaagcatgccccacagaagatatgcagagaggcctgaaataattcctagacgtttattttccatagctatactcccgaattaaatataactattataataccacttgttgcaaacgatttatcacgtttatgttaagtatttgaattagtacggataattataatgagctaaaaggcacaaactctttcggttgatcagaaggacagagtgttttttgcatccaaaagttatctagccattttccagatttaaaacctatttttttaaacaagccaacattctcatagcccattcgttcatggaacttcttacttgtttcattctcttcagtaatgcaagcgataatatgaacaacattttgcttttttaatatattttcaatttcggaatagagcattttacctattccgcgactgcgagcttcttgtgagacgtatacgctaatttcaacggtccatttgtacgcgccacgactattaaactcatgagcgtaagcatagcctaaaatcgtgttatcttcttctatgacgatataagggtatttctcaagcgtattggcgattcggtcttcaaaatcctggatagtaggaacattgtactcgaaagtagaggttgttctttcgacgtaaggtttgtagatattcaataatgttggtgcgtctgctaacttcaccgtgcgaacattcatcatattattactcctagttttgggataaaaaaataataggtaaccattttaacatgagattgcaggataataaatagttaaatgtagtcaatttgttcaagggaataggagttattttgagatagggttcgtttgttgtgaaaagagcaaaaataaaaaagcgattggttagaatcgcttttttattcttcatgcttggcaccaatttggtatatggcttcttcgatatttaagtcttttttcatttgagtaacaatatttgcgcgctgagcagagcttttattgattgcgttgacagacatggtaatgattgaatcgaatccggtatggaaacgtgaagcaacactagcgtcaatgttgtatttaccagtttgtgcggctttaacgatcgtgacaatgccattttgcccatataaggcatcacgaagtgtctgtgcatcagaactacttagatctttactgttttcgttagcaataattttagcatctttttcaattgccgccattgtgctgtcttttttgtaattaaatttacttaaatcatcaatcaatctttttatattggtacgcgattcttgtaaatgggtataatcagcttttggcatagaaacatctgcgtactttggctgttgattaaaagttataaaggcgatgagcaacgctgcaatcacgacacccaaggcaataaatgcttttctcatgtggtattctcccaatgttatctaatgttagtataaatcaatttaagattaaaaaaaatactttcatgaaacgtaataaaatgttattatattatagtacgcgctggtagctcagctggatagagcagccggtttctacccggcaggtcgagggttcgaatccccctcagcgcatttacaccgttttatcacaaatgttgataggacggtttttgtttgcttaagtgttgctatgtaggtgtttgtgagacgttttgtaaatcttcctaaatcgtttaaaattgtcggaaatcgtatttttttactacaatttgctacaaatttgctacaaattactaagtgcattcaaggtcttgtttgtttctaaagtacgctttttatttaacaagtgagcgtaggtactcaatgtgatatttacatcagcatggcctaatctttcactgacgtattgaatcgcgatatcttgtgaaagcaagaaactagcatgagtatgacgtaatccatgaaaggttattagtttactgtcattctttttcaaatagcgttttaattgcttatttacggctgcgttagtgggcggtagacctgtaatactctcaaaggcgtatgttttgccaaatgtccatttttgaactgatttcatgaaatcaggtggtaggtcaattatcctatttgaagtttttgttttcgttgctttgaagttttgatcattagcttgccatgacttattgatattaattgtgttgtttgtaaaattaaagtcatttcttgttaatgctgccacctctgaataacgagcaccggaataaatagccaataaaatcatatgagaagttacagcagcgctattctcgatttctttaataagcatttcaagttcatcattttctaaaaacttcaaatctttgtctttactgctttttgaggaaaaaactttaatatttcttgaaaaatctttattgatgaagtcttcatccacagcgtatttgataaatgaactcagtatatttttgacgtgagcaactgatgatctaacgtggtttttgccatattcatttaccatcttttgaaagtcggaagaattaatttctgataactttctgtccggccattctgttctcagtattttagaaaccagcctataccaaccttttgtctgcgtttctaaaaggggttccttaaatatcgtgtaccactcgtcaaacatttcagctataataccgtctctttttgaaagggtatcatttatttttttgttttccatttcgatagcccagtttgttgcctcacgttttgttttaaaaccagacttcgtttttttcttaaatgaaccgtctaccttgattgaaacactagcagtccagtttgtaccacgtttatagaatgatgccatataaaaagcctcctttaaaaagggggcttatatctgttataatctaatagaacgccccgtgcgtttaacttctttcttagcacacctacttatcttggcggatagggtgtgtttttttatttgctcatttgtttatttcgttcattggttacttttttattatgttttatttctcgctctttttcttgtaggtaataaaataaggcaaatagtgctccacaaatcaatatttgtaaccagtatttatctaagaaactgatagctgaggttataataactaacaaaactaaccacggtatcaatctaaccaatccagttagtgcacaccagaatattgctacaaatccaataatcgcaaatataaacatataagccttctttctataactattataatttacaattgtaaactggtgttataattaaaatatggaaaaatttatattgacaattataacggcttttgtttcagcgggtggtcttggttatttgaattatcaaatattagaagctcaaggctcattaaacgtcgaagatggaagtaagtcgcaaaacatgtgggtcatcatcttagggatgattaatttcggccttttcctcgcgctgactaaagaaatgagtttaattactgcttttttcacaactattggcatgtcatcaataatttttttgattttcggaagaaagctatttcaaatgtattggtggattataaatcattctgtgggaaataacggaaaaattaacgtttctgataaagatccatgggattattttgttgacataaaagatgatagcgaaaatgtgatgttcatattttcgtttgaaggtaacttgattacttatggaaaatttctgggttcaaataatagcagagataagaatatgggtgtcagattgcaagaatacccacaatgggatgaagaacccacattaaattttgtaaaaaaatatgcttctgattatcaagtagtgtcttatttagatactgagagaaaattattatactatattgttactttttagtaggttttggaggggtgctaagtggtccagaacttgctggtcgttggggctttggagtgttacgaacttccattttttcaggcatatcgacatatatattcatttctggattttcattttgtgacatattttattcctttacagcctaagggctttttttattgccttttagtgtggttgcttggcacatagttctatataatgttgaagggatttaaattttctaaccaaacttttttaaccagatgctccattgataaagggagacctagagcatacatgacagaaatataattaggaatatattcctcgtccacacttttaaagaacaaccttaaggcgaagaggtgagctgatatttcctcatctatttttgctaaaggcgaaaaagcatagattgtttgatttttgcttttgtgaagcacgtgaaaaatttcgtgagcttcaataaaagtagaatcaatcgatgtttcataattatcattataaaaaatcatgtttttctgagggtaggcaagaggtggatcatatttttcgaccaagacgtgcttaaccttgatgttatgttccgctgtaattttgtcaatgttttcccgaaaaggagctaaattgtagtcgaagtcatctctcatacattaatcgtcctcttcgctcaatagttctaatatcactctcttgtacttttcagaaatcggtttaccatcaaaagcaagcattgggtcgtgctctaaagcgtattttaaatcagtttctttattcgaagacgaatagctattcatgacatccgttcgtccaagcaaatagtcggttgaaacattcaaaacatctgcaactgaactaattttatcaatagagggcgttttcgttttccatccgtagatagaattgatacccatgtttgatttttcagctaaagtttgaaggctgattttcctcaaatcagcaacttctttaacacgttcaaatatagtcatattggcatttctcctagccttcgagaaaaatattaattctatcgagtaatttaatgttgacatatttattcgatagagttattattaactcatcaagtaattgagcaacaaaaaacaaacacttgtaaatctaacttggcggtctgattactaggtggcgcgttatttgtagcttatttcgtatgcacttagtttactctatcgaataaatttagtcaataacttgatgaataaattatgcaggaggagattacatgccggtagttagcccagaggaatcaataaggagaaagactcgtcgagcgattcgaggtgagttggacgaacgaggaatgtctcaaatagagttggcgaatatgattggtgagcgtgaagacgaagttagtcgagcaatcaatggatacaaagaaacacgctttgtaaaaattcgcgagaaaatctttaagctattcaatattcaagatatttagaaaggaagcgaaaaacatggaagaaaaaccatatcagtttatttatttttactacaaagacggtaaaaggatgccaattttaactggcgctactcgcgaattgaacagcgttttatttacacaacaaaaaaaatccataatcaaggatttctcaattgaaaatggactattcgtttggatagaaggaacagaatttttagtttagtcctaatgaacgtgcaattaagtcagaggcaacttttgaaaaaatctctaatgaagcactaccaacagttgaagttatttttttctttgtattgttccagatatcattatctcgaatattgtccaaataagcatggccattaaacgttaaacttccagattgaagaaaataataaccatcaccaccgggtagtggttttagttttgtaaaaccagcctcaaatattttgtctaaagtataaccaacttgaagcttatcagcagcatgtgattcaccaataagcaaaaattctttgtcagttggtcccctgaggctagaagaattttcaattaatatcaagatatctctaaccaattcatgatcaagtttcattattatagtcctttcgaattactaggcactgcaatgccagtaattaaaggatagcactacaagaacattaaaacattagaaaggaagtaatcagatgtcttttgacataacaaagaattatttgcagaaagaaatacaagaagaactaaaagggatcacctcagaaacgttcaacaaatattttcgaagcgataggaattttcctaaaccgattttggatacaccacgtagaaagatttgggacgggcgagcattagtatggtacttcgataagaagtcaggaaggtaaataacatggaagaaattatcaagattaatcaaaacgatcaaggcgaagcgcaagtaagtgcccgtgaattgtatcaggcattggaagttaagaaacgcttcagtgcatggtttgaaacaaacgccaagcaactaattgaaaatgaagattttaccagcgtactttcaggtacggaggttcaaaacaacggtggtacacaattacgtcaattacaagattattcattaacagttgatgctgctaagcaaattgcgctgatgtctggaactgaaaaaggcaagcaagttcgtatgtacttcattcaagttgaaaaagcatggaacagcccagaccagattatggcgcgcgcattaactattgcacagatgaaattagatcataaggataacttgattgctgaaatgaagcctaaagcattgttcgctgatgcagttagcgcaagtcaaacaagtatcttggttggcgaactagcaaagttgttgaaacagaacggcattgatacaggggctaaccgattgtttacgtggttgcgtgagaatggttatctaatccgccggaaggggacagactacaacatgccaactcaaaagagtatggaaatgggattgttcgaaatcaaggaacataaccacatcaactcaaatggggtaaacgtaacaactaagacaccaaaggtaactggtaagggacagcaatactttattaataagtttttgcaagcagcataaggagaacataacatgtggtttttacaagtaatagcagtagcaatcgtgctaggcgtagttttcgttggtggcatgatacaaggtgagtcacaagagcgtgagcatcaacgtaataagcaccgtttggaacgcatgggtggtatagatgagagtaacaaatatttgcgggttaaataatggaaagaatagctgacgcattaggtgataccttaattgaatttagaacaaataaaaaataaaccccataaaacatgagattcatcgaatttagatactggtgtcgctaataagttgtttagagatgtttatgtgaacgaacgctgataacagcattcacttcaggataaatgtctgtgtgcacaaggtttaattcttcctcaagcgcattcgcagtattggcaacatcgacttggttgaattgtgataaacagaatcctgtttctccttgttcaactttatccttaatcatatcggcgatttttttcttaaaagccatatgaaaacccccttggttcttttacttagctgatgagctagtaatttaacgataccactttatcgatttttaaacaaaaaaagcaatcacgaagggaaataagtgattgccggtaaaacataaaaattattcgaataaattttatgttttcagtataccaaaaagaaaggtaaatgcaaatggtagtgacattacccgaaccatataaatcacgaaatgattttgaggatgattattttgaaggaaaagaagtcgttctgtttcacgagaaatgtttgtatgtttatgcattaaataatacagatgaagccgactttatgtggatgacttatgaagaattgcaaaaagaatgctacttcgtttatgtggtcaaagttggaacggaagaagttgtttgtgccggcgaagcacttggtacgtatttggaaaagaactgcctaaacggtgtgtacaaaggaatattaacgccatatagcacttatggcgaagaagcaattaaagaattggagtggaagtaaatatggcaaatgaaataacaattattgatgactttggtcaaaagtttggattgagtattatgactgatgatgctcagttaaaacagttagataacgctacatttgaagatttagtgtatctaatcaagtatctaaaaaacggcattaaaaagaccgatgcagaattgaaatctcgtttagataaaggtgcgcaattcaaacatatcggttatggagaaagtaacaaacagtcattagcccaagatgacgaagcgctcaagaaagcatttgttaaaaagtatggttggcaggcagtggaagtcaaaacacccactaagttgaaaaaagaatttggtgaggctatacaggaagatttggataaggtcgttgttcacgaaacccaaaatagagtcaagtatgactgatgaggtgttggaatgaaagagctaattgaaatacaaagtaagttagaggctcctaaaggacaatacaacacttttggaaaatatgcatatcgcagtgcagaagatattttaggggcagtcaagccattggctaccgaacagaaagcatcaataacactaagcgatgacgttgttcttgttggtgacaggatttacatgaaggctaccgcaacaatcactaacgaagcgggtgagagtttcagcacaacgggtttcgctagagagtccgaaaataaaaaaggcatggatgattcacaaatatctggcagtgcctcgtcgtatgcgagaaagtatgcactaaacggactgctagctatcgacgatacaaaagatgcagatagtaacgaacaacgtcaacaagcgacaaacgctgctaccggcacgcagagtagtggcaaagccaaacaaaagaacccattgcatagtgagtttggaaaactggcaaagaaaatcgaatcaaaaaacaatattgatgaacaacaagtttactcaattatttctggtcaatttggattgcaagtaaatgagtttatggacttcgttaaattgagcgagcaacagaagcaaacaattattaatttcatgagaaattcggtttcataaaaaatatgacccgatcatcgtcactaaactgattaaccagtgaaaagagtttaagtcgctcgattcgtggatgtccattcgtatgatgacgatgtggcgtaaccgcacgaaagggtgtgatgcccgaaggaggaaatgtggcagataacaagaagtattattatatccgcctgaaagatagtttctttgatagcgatgaaataaaactattagaaagtattccaaatgacggatataagttttcaaatattcttttaaaaatgtatttaaaaagtctcaagtataacggtcgtctaatgtttaacgatagaattccttttaattctgaaatgttatcaaccgtaactggccatagcgtaggagatattaacagagccatcgacatgtttaagaagtttggattaattgaagtttttgataccggtgaaatttatatgctagacattcaaagttttattggaaaaacaacaacagaggctgatagaaagcgttcttatcgtaaagaaattgaagataaaaaagcaattgggacaaatgtccgacaaaattccgacaaatctataccagagatagagatagagaaagatatagatataaagaaagagatagatgttgttgacgacgagcaaaaaataaacaacgacgacaaatcaaaagcttattcctctctggtcaatattctcgaacaaaacggattcggaacgattggcggattagtatcaacagacatcaacaaagaattagatgattttgctgaagccaataatggtaattatcgtgaagcatacagcgttatcttacaggctatcaagatatcagttggcaatggtgtatgtaagtttaagtatttgtggaatgtaaccagagactggtatcaaagaaagttgtttactttgaaagaaattgaggcatctgaaaagaaacgtgatgatgaaaaatctaaaagcaagcaacgcaactataatggcagaccacaacgagtagagccacagatgataacagaaccagtagcaaagtcgaatgttgatgcgtcagacgttgctaaagaacttgctgagttaaaagacatgggactacaaacgaagttggaggagtaaagaatggctagagaaattaagtttagagtttgggacaaccaagaaaataatttttggggtgaaggtcgcaatttatcccttgtgtctatggttgcggacagtttagtcaatgatgatacaactgttttagaacaatatacaggaataaaagactttaacggtgttgagatttaccaaaatgatattgtacaacccattcaatcatatcaaggtgttccaaacatgaaaccgtctaaaagaggactacctatggtggttaaatcaggagattatgtttatggaaagtggattgctagagaagttaaaacaagtggttttggagtatacgattatcatttctcggaagaactacaagtgattggcaacatacacgaaaaccctgaactgttggaggaatgattaatgacatttgatgaagctattgaagatattagaacattatctttaaacgaagaagcaggtttgtcaccgaaagtggtaaacataattattaataagctccgtgaagaatatacaccagctattaaaatgacagagaaacagcatggcgcttttgtaaattggaagtatcatactgctggttggaatatgactaattgtgctgaatgggcaagagatgaaaatataacggccaataatgctatgcaagcatggttacacccagaaacaatcaaggtagttgatgaatagtgactgaattatttggacaagtgaataagctagatccaaacaaagggttagtcacattgcgaatgagcgatgaagatttgcgcacattgcagaagtatcacgcaactaatcagcaacaagttctgtcagtgatagctagtgatgataatgagccaacaccaaaacagcgtagatttgcgtttgcaatattaaaagatatttggaattcacaggttggtggcgtttggttagaaacaaaagagactatgcgtgaacacttttacaccatgtacgaatattactacggtatggaatacggtgaatttagtttgagtgatgacaaaggtaaaaagagcaacacaaacgagttcatcaacatgctattagattacgcagcacttcacgacattgctttgagcgtgaaaccgttgaacgagctggagtcacaggaaatagcgcactgggaatatcagtgtctgatgaacaagtgttgcgtgatatgcggcaagagaccgagtgatttgcatcatttagacacgattggtcaaggtgtagacaggcgcaagactaatcacttgaaacacagagccgtgcaattatgtcgggaacatcatcaagaggcacactcattaggaattgaaatattcttacagaaacaccacctgacaggcatccaaatagatgagcgaattgcagcggctcatagattaaacattagatagaaactaacaagtgttttaagtcgttaaacactgtttaggtataaattacactaaaccacatttaaaatgtcaaatatgatggtttatgtggacgcgagagcgaaactgagaaaagctatttaaaaattgagatagaagaacttacattaggcttattggatataaagaaatgttacatatgatacttagatcgtttgtaaattgattttttaaaaaaatcgtttaaattataactaagagttttgagaccagattttctaatttcacgatgggttattaaatcgtatttttgtttttgtacctttactctcattttccaaggaaaaattttacttctataaattccaaaattaacaaaaatgtttccttgagcagagtttacaacactttctagcatagctatatcaatgtaagatgtttgcttggcaccgataacatgtgttaaaccttgtggtaaatgagcgacaaatccttctctgttgatattcatcatacgaattaaacagtccttgtttccataagtaccgtgcacattatctttagtaaaaatattaagttgtttaccagtattatcagttaccttgaaatctgataatccaacagaatggttggcggtgttagtaacatcgaggcggtacaaaataagtttatgtgtgttgtgatcggttaacctttctgttgtctcttcttttccagtatctagaacaagcatatcaaaatatcctgtttcccatatatttaccactgcaacatgaccacgaacatataagaatgttaaaaatgatattagcaacgatccagatgatattattaacgcaaaaatattcacaatatttaatccccactacttttgataaagttattattacatatgatttgtaaaaatgaaataattgcaatttgaatgaggagaaaccattggcagatagaatagacagatatttaagtaactattattcaggtgtaatcgacatgcagattaagctacgtaagatagaattgcagacacctgaaacggtagatgaaaatacaggcggtggcactgctcaaaacaaagaaaacagagttctggataatcagctaatcattgaagagagcgattatgcgttacagtcctttatccgtgacaagtggtgcatgtcaaactttttgaagatactaactgaggaagaaagagccatgctatctttgcgatatgatcgtagacgaaagcgtagttggagtcaggtagctagaatactttctaaatcagagagccagtgccatagagatttgcagaatattaagcagatatatcgaaagtcagtgtttgcttatcagcctgtggataactcggagtagcggaaacatgcgagtttttagacagtttttgacctaaaaacagtgtgataattgtattgttgataattatcaatcagggttatcgcactaaccaaaagcatatccgaaaaaagattgagtgattcttttctacgaaatgtcagcgatgctgtttcttatttttctaatcactccgttacacacgcttcgggaaaagccactgtgtatgtaaaaatacgataggttggaatatctatcattatgacaggtggcggaataggtagacgctgagaaaatctgttaagagaacgggtagacgcaaagtggttataatagcgcagttaaagagtagaaaagccaccgcccaataacattaggaaagtcgaatacagatagagcacttatagtggctgccaatcctaatggtctcgtgcaaggtgcaaatccttgccctgccaatagagggctatgtcctccagcctgacgaggcttgaaataatacgtatcagtcatcaccatagcgacataatgtctctttcaatcacggtaactcgtgtaaaaagattgtagctcgttgctttatactagttaggtgatttctgtgggtgaatgagtaaagctaaaaagcaggcataacagtcaggttcgagtcccgccattcacattgcggtcactcgcaaacacaacttaggataatgacatttgcctgtctttatcgtacataggagcaatctgagttgagtggtgtttccatatcactataaaatcgaagtgagaaagaacggctattggtctataagcagtcttacaaaaattagtatctagacaagtcgattgtcagacgtgacaagtatcggcggtacataataactaaactggtctttttcaaccagtttaaacacgcaccttaacgggtgcttttttattggagttaaacatgaatgaaacagagaagaaactacgcaagagacgtagacatataaaacaggcgactgatgttaatcgcaagcacgctgacatgatgaaaacagagagcattgcacgtcatgagcgatcacgtattcaggttcggtcagaagtgatggagaacagacagattgactacaagagccatatgaagtggttagagaattaatggcccataacgtactatgatgtgaacaacacttaggagaatagatatggtattagtaagagaagaaattaatttagaagacattaagcgtgaatcagatgctgatttattagttgaaaacataattctgacaacgcgcataatctctcgttttcaggataggcaagttaaaatgagtgacgtgatagaagaacaaaaagaaactataagcaagctagaagatgatattcaacttctcaaaaaagagaagagatggaacatgttatggcgtaatagcctagaggaagatattaatcatacccaaatagcattatttgttgtaggagtgattaatgttttgtttactttcttcatgagtaggtgaattaatgttttagttacatgagccactctctatagtataattactgctattggaggaatttggaaatgaagagaatttttagtcaagtgaaagaacattacgtaattactattgtgttgtttgtatcattgattatgtttgttttagttccgattattatgccttttactggtattgcggatactatttttgacaaacatgaagatgcttatttgggctattggggaaacttcgctggttctgcacttgcattaataggtggatatttttttggtgttagccagcaaattcaggagcagaaaaatcgatcaaggagtcaatataatttattacaaaatgatttatatcaattgaattctgatttaatatcggtaagcacaaccttgaaaatatataaagataaggatatttcagagcatggagttgacatgctagtccagacgctctcaaataatttagaaaaatgtgaaagcatcgtttatagagttaataatttaattttaaataattcttctctagtatatagggatgaattagaaagtcagattagagaatataataaaaagaaaatacgcttgaatagtgtattagctaaaatagctatcgagtctgaattaccaagagaattaatgaacaatctcgttactgagttatataatttcacttactacgatcgtagtaaaatttacaaattagcacaaaaatatgaaacctatatcaattcataagcgcataagcgttttttattttgcaaacttaataatctatgacgttaatagtataatctatactattggaggttggagattatgtttgatcaattttggaaaaatgcactattcacgattttttttggaatgttgggaggattcattgtaatttctatttttgcagttttacataataggattacagatgtcggaagctgggcggattggttcggagctattggcaccataggagcggtaattgtatctttgtatttttctaataaaagacctagacctgatttagaagctgtttttaatgaaaatgttatgatcaacataggcggaaataattttaggaatctaatgtcatgggaaataaaaaactattctaatataccaacgagtataaccttagttggtgccattgttagtgaaaagaaaaaagtgaataaaaaatcaaaaattaaaaattttatgattttgaagccaatagatatttttagaacacatagaatacccattgatgttgaagcgtatgctgttgaaacaattttatatgaattcgaaggaatacaacaaacactagaggaagaaacaaaatggcaaagcatcacttttttctgcaaagataatttcgataagtactattacagttcaaactatcaaacaaaatcattattacaaagaatgaaaaaacggacaatattgaatgatgcaagcgcatgagcgctttttattttgcagtgaatgaggaaaaaaatatgtggattattaattacgaacataagccgtttggtttatccggttcaccagtggaaaccgtaagagaaactttcgtcttcggtatcattacgaaacagaagaagttgttattggtaaaatctaatttctattccgacacacgcctctctatagtataatcattctattggaggttgtagatatgaaaaaatgggaagatgaacttcaagaaaaagctaaaaatattttggaaaaccacaaagttatcctgttgatatttacaattgggtttcctctggtgattcaaattgtattcagtattttgaacattgtatctgacatgaaatcatggaattttaagtttcctgattcttctaattggatcggattttggggcagttatctagggattattccgtcaggattaattgcttacggagtagcaaaaatacaaataaatactgaaaataagagacaaaaagaacattttaaaataaatctttactttgaaaatctgattcgttttaacagaaaactaagaagattggatcctgtatttgaatatggttcgagtaattggtatttaataaacaatgattttggtccaacggaaaacttaagaaaaataccgaatgaaagaattgaaaatgaactaggaataatgactgatcaattagttaaattagatcctcttatcattcttagtgaattaatattggatggtaatttaatggtcaatataaaagactcaaacattaacgatgatctaaccgaattaaaaaaaggtatgtcaactctatcctctttatttaatgatttttacaaagatgatcacagtgaggatgaaggagataatatttttaaaagtataaaaaaaacttatagagagtgctatgatttataccacaatatattaaaagaaatttcttgtgaaattaatagtcttgataagttaagcgcttaagcgttttttattttgcactaaaacagtgaaaggaggtttattaaatgactacattcgatcggagtatcgtagaaatattgggtgtggtggatgtaatattatttacgtttttgattaaatatatattgtatgagtgccatggctagagttagacgttgtaaagccaatggctgtttcaatatggttgaattacctaagcattactgtaataaacatgcagatcaagaacgtgtgtatgttcctagagataagcaagcaacacacagatacaatacagtgacacgtaatcgtgatgacaacaagcgtggtcagtataacttctaccgtacaaagcaatgggttaacctaaggcaacgagtgttagatgaacaacattacttgtgtcaatactgtaagtgtgatggtgtagtcaagcaaggcaagacagtagatcatatcgtaccagttgaagcatccccaaatgataaggcagacatagtcaatcttgcagtgacgtgtagtagatgccatacattaaagaccaagtgggagcaatcctattacggcacaggtaaggacaatcagttgaagtatgttagtcctgttagaagtattgcaatgattaataagttgatgaaaggaacatagagagtggtaaccaataaacaactaagagaaagacttcttatgagtaagcttaacttacataaacctacaataaactttgcagtatgtattgatgagtatggtaataaaaattttaaagtagccagcgttacctatcccaatcaagagagaaagggttaaaaattttggaatgtaacaaccgctaattgttcataaaattgtttttaagatgttttaaacagatctcgcttattgataccaaagaaaaattaaaatgcaaaatacccccgcccttgttcttcagattaaagagcgcacacatatcgtcatcttgtaaaaatgttcaattttaaaatttttaaggtaggggggggcttgacaagaaaggaggtggttaagcgttggttaaaaaagttgataaagatgttaacggcgggcgtttaacgattacacctccggcctacttaggacagcaagcgaaggtgatttggcgtaaagttgtgccttttttagaaacacaaagtagcgtcaatcgcattgattctggtttagtagaaatgtattgtacccaatatgaaatctatagaaatgcttacaaacatgtgcgagaaaacggagaagtacaagcgatttataaacctgttcaagatttcgagggaactgtaatcgacaaaacgtttcagggatacaaacgtaatcctatgacaaatatttatagcgattccttaaagaacttagcaaagatagggtcagaattaggcctatcaccaaagagtcggtcggagttaatggaattaagtgggaatgatgatagtgatgaaagttcaacgtcccaaatgaaggagttctttgctgatgaagaagattgatttaacaataagccatgatgttattggcatctatcattcacttgatttttcagacataaggatgcgctaccacgatgagggaacgcaatatgcttttgatgttttagatgaaaaaattgaacaaggctactttattaagttggcatcatttagacatttacgtgacttacaaaggcaaggggatgatgattttaaatttcattattctgttaagcaagccaaaaacattcttaaattcgcaagtatttgccctaatgttgatacaggcgaacctacagagttaatggattggcaaaagtttatcttagctcaaatgataggttggcgaaacgaagatggcggtaaaagatacagccgtgtgattgtttctgtgtcacgtggccaaggtaaaacatatatgatggccatcgttcaaacatattcattcttggtagaaactattggacttgaaaaccaagatttcttagttgcttcaattaattttaagcaaacaaataaattgtttggatacatcaaaagcatgatgcaaaaactaatcagcaagccacccttcaaaacctatgcagaagaagttggcttaatgatacaaactgatcagattattatgaagaaaaagaacaatgtaatgcgtgctatttctcatgaatcaggtcagtatgatagtttccacttcacgactgctattgttgatgaaataggcgaaatcaaaagtcgtgataagatatctaaaatcatatcaggacaggttaaggttaaaaatcgtcaatttattcaaatttcaacctcatacccagatccaaccgttccatttcatgaagaccaaaaaatgattcaacaagctatggaacaagattggaatagagatgctgatagctatctggggttgatatgggctaatgatagtcttgatgaaacatttaagcccgaaacttggataaaaagtaacccgttgcttaatttggaaagcgaacaggctgttttattgcaaggattagtggataaaagagacagtgatttgttagctggaaccattagcgattttcaaaataaaaacttgaatatgtggttacaagaatcaacaaatagctttttaaagttatcagatgttgagcgtgcaattactaataggtttgaaatttatgggaagcaagtatacataggttacgattactcaatgtttagtgacaatacagcgattgcgtttgtttatccttatctcgataaaaattgcaacaagcgatggcatattcagcaacattcgtttataccttgggaaaaagcaggcagtattgaagctaaagagaaacaagatggaattaattaccgtgagttggctaaaaaagggtattgcacaatcacgtcacacccacaagggctgataaatgatgatcaggtttatcaatggctattaaattatgtagaagacaacgctttagaggttgtcttttttggttacgatgcatggggtgcaacaccagcaattaaacagcttgaattaaatacatcttggaacttgatggcgattcgacagcggactagtgaattgaaagaccctacaaagttcttaaagtctgcctttgttgagagttcaattacacggcttgatgacaaaataatggaaaaagcgttgttgaatgcacaagttattgaagacaagataggtattcaggtagataaagcaaaagcaacactcaaaattgatgttgtggatgccattattgatgccttatatcaagggatgatacattttgaagattattcggatgtgaatgacccagaaaaacaaatcgaacgaatgacgccacaacaaaaactagactggctgcttagtgatgaagccggactgatgggagatgaactatgatttttaaacaactattgccgattatttggcgaatatttgacttgctatgttatttagcagctttaattacgattaattgggcaatgtttagcttaaacaaaatagcgggtggcgttactttagctctttcatttgctgttacgggattagttagtgaattgattgctaatagcacatcgaaagggggtgattgatattgccattatttagcccacgctttaaaaatagcttagatgtgggtggtggtaacgaaattaattttgatgatcctgaaattgtgaactttttgaatccggtaggtaaagatgattacgtgagtgcagatgttgcattgcggaattcagacatttactctaccgtttttcaattaagcgcagatttagcttcatcaaagttgattactgataattcgcagaatcagagtatgttgaataatccaacgacttggacgaacggacatagcttttggcaagcagtgtacgctcaactattgttgggcggtgaagcctttatttatcgttggcgtaatcgaaacggtatagatatcagatgggaatatttgagacctagtcaggtcagtgtctttccattagatgactattccggattgtactacaacgttacgttcgattcgccgttagttggtattaaacaaagcataccatcaggagatatgattcattttagattgctaagccaaaacggcggtgcaaccggaatcagtccattacggtcgttagctagtgagttgaaaatcaaagagtcatctaacaaattgactatcaacgctttagcaaaatcagtcttgacccctggtattttggaaactgacggtggcggattaatgaacgctaaacaaaagtcagctcgttcaaggcaatttatgaatcaagttaacaattctaatggtgggccaatcgtaattgacaaattagaaacttatacaccacttgaaattaaaggggatgtttcaaagttacttgctcaaacagattggacttccaaacaaattgcaaaagcctatggtatacctgattcggttttgaatggacaaggcgaccaacaaagctcattgaaaatgataggtggtgactacgccaaagccttaatgaggtttggacgttctattaccagcgaattatccaataagcaatcatcttcggtcgatatcgacattaagccggctatcgacccagtaaatgatgattacacaaccaacatcaacgcatttaagcaaagtcaactactctcatcaggcgagagtaagtggctactcaagaagacaggatatctaccgcctgatatgccagatattcctgaaacaaatacagaaaggagtgaagatagtgaccaaaacaattgatattaagggcaccgttgttgatgacgatacggctgcgttttatagtttctttggtattcctagcgcttcaccaagtgctgtttctcaaattcttaatgatgacgatgaccctgacaatcctgatacggatgttcaagttaacattgcttcaaatggtggagatgtctttgctgcgagcgaaatatttacattgttaaagtcggctaacgctaatgtgactgtgaatattcaaggattagcagccagtgccgcaagtgtcattgcaatggctggtgatacggttaaaatatcaccaacagctcaaattatgattcatcaagccgctagttatgggagtggtggtttgggaggcaacaaagatgacttagccaatgaaatagccgatttatcacatgaaattgatgtgctagatggcattgataagtccattgctaatgcctacgaatcaaaaacaggcatgtcacaaggcgatttgctcaacatgatggctaaagaaacatggattggtgcacaggaagccgttgataagggatttgctgatgaaatcatgttcgttgatgaaaaacaggcagctttctcaaacgcaacggccaatattgtgcctaaatcagccgttaacaagctattaaacttgttgaacaagtccgaaaagactaaaaaactagaaaatactactaacgaaagtcaacctacggacgctctaaagcaaagtaagttggctattttactagggaaagcaaaggagaaataattaatatggcagtaaatattaacgatttgaacgaaaaatgggtgaatttagggcaaaaagtctctgatttacaaaatcaagcacagctcatggttgatgatgatgctacttctgcagaagatgttgctgacatccaaacaaagattacaaatgcgatcgctaagcgtgacttagcacacgaaaacttggtgcaagcacaagctgagaacgtggtcgatgacaacgtagagccaacgcctgaattaacaccaaaagaaaatgacttgaagaaaaagtttgttgacaattttaagggcatgatcaaaggtattcccagtgttgttaaccaaattgactcaagcactgacttgaatggtaatgctattggtttgactattccacaagatattcaaacagctattcacacgcttgttcgccaatatgatgccttggaacaatatgtcaatgttgaatcagtatcaactttgtcaggttcacgtgtttatgagaagtggtctgatgttacaccattggccaacttggatgcagatgatgcaactattggtgataacgatgaccctaagttagcaatcgttaagtacctaatcaaacgctatgctggtatttcaactgtaactaatacacttttgaatgacactgctgagaatattttggcatggttgtcatcatggattgctaagaaggttgttgttactcgtaaccaggctattattgcggtaatgaatgctgttccaaagaagccaactgttgctaagtttgatgacatcaaggatatggtatcaactgccgttgaccctgctgttgcaactacgtcattcttcttgactaacgtatcaggattggctgttttgaataaggtaaaggatgcaatgggaaactatttgctacaaccagaccctacacagtcagatgtaaaagttatcgatggtaagcaagttaaagttttggctgatcgttggttgccagatgtttcaggttcacacccattgtactttggtgacttgaagcaagctgtcaccttgtttgaccgccaacaaatgtcactgttgtcaacaaacatcggtgctggtgcttttgaaaaagacttgactaagattcgtgtcattgatcgtttcgatgttgagccaacagatacagagtcttttgttgctggttcatttaaggatattgccaatcagacagccaactttgctgcatctgcttcaacaggtggtcaagggtaattgattttttaactcgctttggaaataaacagttcacgcaagtgggcgggtgttaggaggttgcatgacagtaactttagataatttaaaaatatctttgcgagttgattctacggctgatgatgatttgttaaagggatatatcttagcagcgaccaactacatcaagaatgctattggtactgatgacgataaattctatgctgatgataatatctcttcacttgtagatgtagctaccatcgctttagcaagtggctattatacgtttagaacatcattatcattagttcaagccttcccagttgatttagctactaattccattattgctcaattaagaggtaactatgctgattatttagcagataagggggtgtttgatggcgataaatccacttgaatttaacgaacgtgctgaatttggcgttgagggaacaactggttacaatcctaagaatggtaacgccataaaaggatttgtggcatcgttttcaagatggtttggttatcgcacgcagtctttgaatcagcaatacacgtttatgggtaactcgattactgataccaaactaattgcaatacgacatgatgatgcagtaaacaaatcattaaacgttagaattggtcaagatatttacgatattattttgattagctctgacgaccgttcagcgcgagaaacatttgatttgctcaccttgcagaaggtggtgaaaaatggctagtctatccgaacaacttgatgaaatattgaaagaagtaggcggtatcgttaatctcacaatcgaagaacgtgaagaagtcacacaagccggtgctgatgtattagctaaaaacctgaagaaggctacaaaagatgctggtcactacaatgctaatcgtgaaattggtaaaatgactcatttggcagatagcgtagaaatcggcaatttagatggtactaaactagatggcagtacagccgttggattcactaaaaaagatgccaatcatgctcgtatcgcacacttcctgaatgatggtacacgttttattcagggagatagcttcattgatgattctagagataaatcgcaaaaagaagtattagaagcacaatcgaaagtgcttaaaaaaatacaagagaagaaacgaggtagttcatgacagtagtaatggataccttcaatttaataaaagaacatgtaacttggacagatggtatttatcctaagttgattcccaaagaggtgcctgctagtcagacatctcttttgattagggatgcatacagtaatcttggtagttatggtaatgatacgttcaacaccattgaacaaaacgtcattattcaaatctattattcactagatagtgatttggactatgacgaagtcgaaattgagttgatgaagttcttaacctctaacggttatacggttaacgacattaaaggtcgtcaaactgacccagatactgcacaggattatcaaactattcaagttacacggaataaagtcataaaggagaaataatacatggcaacattaggaattgcgggtgctaaattagcgctggtagacaaaaacggaattgcattaactggtacagatggtattttcaagtacactgaccaggctacaaccgataaaacaggtatctttgatgttacggtcgatacttcgtttggtgtggcatcggttgcattaactaacttgttcggtacaacaactgatattttcggtaacaacaagttggtatataagtcggcaggtaaaggcgccgctcaaactgtgcttacagttaactcgttaccaaatgaaattaaaatggctgcgcttggaatgccatctgatggtaagggtggtttcaccattacaggtaaggcagaccctaacaatcgtgttgcttatcttgctgaatcggcagaagcgtttgatatcgataagcccgtttatgtaggtatgtatatgggtactgcatcagaagcaggtgcaacattgacttctaacaacgccaatgataaccgtacgactgatgcaatcactattgcgggattagaacgtggtgatgatggctttggtaagtatttctatagttcagcgccaaagtttgacaagtccgcaatgctggctgatgtgttcaagactgctactactggtggtacaacaacagacggcggtcattaatctttacaagtcacggaagtggctttttattatgtctcaaaacgaggctccaaaacaaatatattaggagaaaaaatcatgtcagtaaaaattaatgttgcaaaagaattaggaattaaaaaagcaatcgaagtggagccgactaacaaagttgtacgtgacacttggaaaattcaaaaaacacaagtgaaaatgaagattaaacaagcaacaagagcagatagcgaagatgctattgaagaaatgctcgatttgatgttagctactcaagatgaaatgatttcatatgtcacaaatacccttcgattgacatcagcacaagctaagaagattgatgatatgacatttaacgaaactgttgatttagctaataaaattagcgcggaaattttaggtattaaaacagttgaggcgactgaagaagaagtgggtttagaagcctaagagaaaaatttgatgcgctcgacacagctataaaagattttgattataacgaacaaaatgttttaacaagcctgcacatattgccatctgaatttgaacaagaaaatttttatcgtttgaatgaagtgttgagtgctcaaagtcaagaagaaaggccaatgactggttcacagttcatgaagtcactaggaattgatccaaatacagcagaacaatctatttagaaaggagataaacaatggctaaacaaatcgttaatgaaatggctactaatttaacgctcgattcaaatagtgcctcacaagcattaaaagaattaacgcgtgaagttaaaaatagtagcgctgaagctaaaatattggaaaatcagtataaggcttcaggagatgcggttagctcctccaaagctaaatatgaaggactgcaaagtaccttagaagcccaaaaaactaaaatagaagcacttaaaagtggtttggataatgtaaacacaagcaccaagaagggacaagatttacagcaatatcttactaatgaactggcaaaagcagaacgtcagtatgcttcttataacgggcaactcgaaaaagctaaacaagcttatacttatcaagaatcaggattagctaaacttaatagcgaattaaagcacggaaatgatctaactgaggctagggttcagaaattacaagcagaagggcgtgaagatgaagctaataaggttaagcttgaaaatcttaagaacgttcaaaggaattacacagagcagttatcgatacaaaagacggagcttaataagctagctgaatcaggtgaaaagaactcagatgcctataagaggcaacagctcagagtagaacaaatgggggctaagttagcttctactacttctgatattaagcatttcaataacacagagattaagccagagactagaggtatctcatctgctaaaagtaagctaaatgaattagatgacaaattaacaagtacgtctagtcattttaagtcagttttcttaggtaacttagcagccaatgctgttactaatgcttttgaaacggtgaaagaaaagctttcagagactgtacaaggtgccatagaatataacaagcaaatgcaagttatggatgccacttggactactctaacaggtgatgctgataagtctaaggaaatggtttcaggtattaagagcatatctactgcttttggtcagactaccgacttaactaacgaacttgaacagcaattctaccacgtattcaaccaaaaagagcctaccgaacagttaactaagtctgtattgactatggctgatacgataggtctttcatcagaagctacagagcgtttaggtcttaacttcacacacatgatgacctcatcaaagatgcaattaggtgatttcaacgttattaccgaccagttgccgatgtttggtgaaaagctgttagagttcgaacaggaagcacaacataacacgaagctaaccatgtctgagttacgtgctcagatgactgcaggtaaaatatcagccgaagatgcagaaaaggtcatgaatgaactgggtgataagtataagacagccagtgaaaacatgttacagacagcatcaggtatggaacgtgttatatcagcccgtggtgaagcattagctggtgctttgattaaccctattatgaatgctaaaaacccattgtttggagcaatctcaaagtgggtttctgatgataggactgaaaaagagtttaacaaagtaggtgaatcaatatcacatgcctttagcacgattacagaggcattcggtaaagagttcaaggcaaaagacttcactgaagctgctaacaagtccctagagagcatggcaaagaacatagagcgtttcggtgattacattgccaagcacaaggattcaattatagggttctttagtgcaactaaggacttatcaggcacaggctttagtgttatgggtgacacccttaagatagctatgcctttgctagaagacctaggacaatttgctcagaagcacccagagcagtttaagataatggctgaatcaattatagctattaacctagcgttcaagggtatgcatggcgcagttaaactagccaacacagtactagatacgttgagtggtttagccagtggcattaaatggggtgctaaggtacttggtattgaagctgagactaaggcaatccaagagcaaaacgctgtactgatggaaaataacgccctatcagcaggtggtggtgtaggtggtactgctaaaacagttgccacaggatcagaaacaataggttctagagctgcaggtgcaggcggcaccatatcaacagcaggtaaagtatctaagtttggtaaggttgcttcaataggtgggcaggttgctagtaaggtagtagccccaatatcagctgcaataacagcatttgatgttggtgattctatctacaaggctttcacttctaacaagtcacaagacaagattaaggctgctggtaaagtatctggaacagccataggtggaacaattggcgctgtgcttggttcagtaataccaggagcaggtacagtagctggtggtctattaggggcttctattggtgatgccttaggaagcactaagacagctgaaaagatagtaagcaagttccataatacctttaaggatgcctttaagaagcaaccagaaataaagataaaggcacctaagctagatactaagtcagcttatgaagagttagacaaggcttctaagaagtactatgacaaaaaggctgaaagagatttagctgatattaaactgttaagaaaaaacggcttaatgtctaaggaagagtacgaaaacagactaaaggatattcaacaggaagctgataaaggtaagagagttgaacggcttagccaggaagaccgcactaccttatcaaagtattatgcaactcaacgccagaagttagaagagtcatttaacaagaaaaagcgtgatgataccaagtcatgggatacaaaaatagctaatgatgcagcactatatggtgctcagtcgtatcaagttaaacgtgaccagaaaaagaaagaacaagccttagaaaaggatgaccaaaacaaaaagaaagccattaatgacctcacggttaaaaatgctactaaaacatccttagaagaggctaaagcacatggtacagctactcaaaaaatagaaatatcaagcaacaaacaaaaagaaatattaaacaagcttgtcgatgctaagggtaagctcactaacaaagagctacaagacttacttaacaggagtcaaaaagaatataacactgttaaagaaaatgctgataaaaagtataaggctgctaaggatgctgcagataagcaatataactcagtaactaaagcagctgaaaagcagtataacaaggttaaagattccgctgataaagagtataagcacgttaagaaagctgcagacgaccagtacgaaaacgttaagaaagcagctgaaaaccagtacaaagcagctgaaaagagtgccaacaagcaatatgatgccactgtaaaggctgctgaaaaccagtataaaggtaacagcaagtgggctaaggaacagcgtaaaaaggttactgatgaagctaaccaccaaaaagcgcaatccattgaccacgctgtagaccagtataatggcacagtcaagcaagcatcaaagcaacacaacgatgtacttaagaaagctaaagaccaacataaagatgttgttgacaaagctaacaagcaaaaagaagacgttatcaacaagtcagtagatcagtataacggagcccttaagtcagcaacaaagcaacgtgatgatgttgtagataaagcacgtaaacagcgtgatgattctaagaatgctgctaaggaacaatcccatggtgttgtcagtcatgctgtagcacaagctaatagctcaatggaagctgcttctaagcaaggtaagggtactaacagtatctggagcaacataggacaatttttcaacggacttgttaaagggttcggtgttaaaggtgttgatgttactaagggtaactacagctacacgcctatgggtatgccagcctatgcaacaggtactgatggcgcatcaggtggtcaagccttagtaggtgaagcaggtattgaagcccgctactcaccatattcaggcaagatagacctactaggtcacaatggtgcgcaggttgttaacttaaaccctggtgacaagattctgaatgctagagacacagctaagttgttccaaggtggtttaggtaagacattaccaggatatgctaagggtacttctagtctagagtcattcattagttcagttactaagggtgctagcaatatatgggacgatgtttcagatgcagctagtgatgccttatctaagattacagaccctatcaagagccttacagaaatagctacgaaagcctttgatgttaactcaataccagaagttggtaatataggtcatgcctcatctaagggtatggtagatgaaagtatcaagggtataggtaacttcctaaagaagcttatatcaagcaacaactctaaccctggtgacggtggcggaggtaaaggcgcaccaagtggtgcaggtgtttcaagatggcgttcacaagttgtagatgccttaaaggctaacggactttcaacaagttcaggcatggttgataaggtgctacgtcagattcaaactgaatcaggtggtaacgaaaaggctgtacagggtaacattggtgacgttaacaacgcatcaggtgacctagccaagggtcttatgcaggttattagtgctacatttaatgcttataagttcccaggacacagcaacccatttaacggctatgactcattgctagcaggtcttaactatgctaagcacacttatggtaatgatttatcattcttaggtcaaggtcatggatatgctaacggtggtttgattacgaagcatcagattgctgaaattggtgaaggtaataagccagaaatgattatacctttggacggaatgaagtctagtcgcggctttgaattgctaggtaaaacagcagttgcaatggcatctagagatggacttacaggttctaatgcaactagtgatagttctacattagaatcaaagattgaacaaggtaaccaattgctaagtacaatggttcaactattgtcaggcatcctaggtcaaactacagaatccaaccagtcagtagatgacattactatgaataagttcagtaaagcaataattaacaaagcggtaagaagcgtaaattaaaacaaaaaagtcgccaataaatgaacaatacctaataggggcgggttttaggaaggaatacatatatgagtatgttcgtgctacacaatgcacgtggtgaatcagttgatttgaattctgaaaatttattcggtaatacaccaacaggattgggaacagtgtttacaaacacttatagtcaatatgaaagttattttaaagcaactaaaataaatattcagcaaggacagatgcaattaaatatattgtttggggatgttgaaagtcgaagttaccagacctttagtcagttttccacattcttatcttttcaaccattgacattgctgtataaaaccggtgttgatacttggcatcgcgatgcaaggttaactagcttaaccaagacagaaataggcggcacaacagtattacaaaccgataaattatttgagcaatttacaatagagttcatcaacccttggtataacaataaacaaggtagatacaagacatataacattgacacaggtctagccatttatggctcaggcttttttaatgagcaaggtgactttaaccagaacttgatactacagtcatcaggtgaaaacgcatcagctgatctaagacctaatttatcaggtgtaacaaataataatatcaactcaaccatttcatatgacagtgatgctattacattaaattacacgggtacaggttctacagaatggtactacggactagcagaagcgtgggctaatatgagtgattcagtccttagttttgataagacgtatacaatttcagtcgatgtaaaaggtaccgcaccaagtgtggcatttagggtaagtaatacattctcacctaccacaaagattaataatgacacgtggactagagcagtttacacgtttagtatccctaacttaacaggtgctacattaaacaagttttacattcgattaaacgcaatggcaacaaccaatgcatcaggattcgttaaaggtcaaacacttagattcaggcactttaagttagaagaaggcgacaaagccacatctaatacaagtgccccagaagatggggtaacagatgcaaacatgaaatatggatttggattcatgggcgttgcttatgacgatgaaaacggtaataagccttacgttgatgaggcacaagtagacataacaagtattgaataaaggaggtgatactttggcgtaccaaccaacagactgggaacacggcgatataatcacaggcggaaaattaaataagattgaaaaagagctaacgcatgtggctgataatgccacttatggattcggtggcgctcaattatcaagcgatggcttaacccctttgagttatatcaatgctggtgaccctatgcctgctaacccacaaaagggtgatgcggtattccttaaagatggtaatgacttcctaatttactcatacaatggcgaagattgggtactaaaagttgacccagacctaagtaaccgtattgaagagactatcaagacagcttctgacaacacagacaaagctattgctgataataacacccagattaatgaaacaattaaccaggtagctaaagaacaagctgatttagctgttaaagatggtgatttcaacaataaagcacaagctatggctgataaagcactaaaagatgctaaagataacacagctacagtagctaaaagcacattagacacagcaaataagaatatagcagatgctaagaagtcattaacagacaatatagctaaggaagtatcagatagggcatcagcagtaagcgctctagacacaaaggcacagggttatgcagatgatgctaagaaatcagctactgatggaatagcacaagaggctaaagatagagctacagcggtatctacagttgataaaagtgctaagggttacgcagaccaagctaagcaagatgctgtagatgtagcaacaagtgcagatggggttattaataagaaaattgatgacacagcttcaagcttaacgtcaactataagtcaaaataaaattgatgcaaatggcaaaataagtactgctcaatctacggctactcaggcattaaatggtttaactacaaaagttgaaaagactgaatatgataagaagacaggtgatttaactactcagttaaacactaccactgctactgctactcaatcaaagcaagatattgtagatatcaaaagcaaaaattctagtcaagattctaaaattaatagtattgtttcagatgctactaaaacacaacaaactattagtgatattcagaaatcacaaagtacgcaatcagataagcttaaccagataacaactgatgtaaatggtacaaaacaggaaattactgatattaagactaaagatggtcagcaagatacacgcatgggtacccttgaaacatcagtatcaggtgtaaaaagtgactttagcacttataagacagatgcaaacggtcgtatcagcaccacccaaactacagcccaaacagcagtagatgggttaaagaccaaagttagtcaaactgattataatgctaaaacagggcaattaagcactgatgttactaacgttactcaaacagctaaccaagctaaaacagatatagcgtcaatcaagcaaacagacaccaaacaagatgcacgtatgactactattgaggctgatgctgatggtactaaaactactgtaagtaacttgcaaaaaacgcaaaacgcacaatcaggttcgattagtacattacaacaacgtgctgatgggtttgatgcaactgttacaaaggttgataacctagcagtgggtggtaggaacttattatctaatactgataaaacatttacaggagttggtagtaatagtgccaatggtaattttaactctacagcattagtatttttggttaatggctggaaagctaatgatttatatgccaattttggaaaagctcagctaacattatcctttgattgggttgctacaggttcgacattatcaggtacctttaccccacaattcagtaatgcaccctggggtgtttttaacacggttggcaatgtaaaagtagcagacaaagcaggtcactatgtgtcaacaacagttgcaatgagtgattcatgggctaataatacctcagcaaacaaaattatgtttagacaggacggaatgcaagggactgttactattactaatattaagttagaagttggtaatgtgccaagtccttggacgcctgcatatgaagatttgagcagtgcaactgctaaagcacagctaacagcagaccaagcaacaactgcattaaacaattataagattaacgcagatggtcgtataactaaggcacaatctgatattacacagactgctaaggacgtaactactaaggttagtcaatcagattatgataagaaaactggtgatttaagtatatcagtatctaaggcacagcaaaccgctgatagcgctgtaacaactataggaaactacaagactagtaatgataatcgtgttaaagctacagaaacatctatagcacagaacactaaagatattactttaagggctacaacatcagatttaaatactgctaaaaaagattataatgctcaaattgcacaggttaatgtaaatgctaatgcaatcactaaccaagtatctagcattcaaactaagataaattctatgggtcaagtcaatcagttggctaacacagagtttaatcctgatatgtctggctggtatggttctacaatcggggcaagctcagaccctacaaagaatgctatagatagttcacatgttactgctttaccagggcaaggctactcatcatcaaatgcagtgctatttgatactacagaccagacatcacaattttatgccaggttaatacagtacgtgcccgttacaggcggtacatcagtatctatgagttggtatgtaaagacactaacctatggaacttacacaaatatgtggattacattctgggataaaaacggtaaaaacgttacaaacggtagcttaggtggtacttggtctaagggtaaggttactaatcaatgggattacatgacactaccatcattgactaacatatcagtgccagatactgctgtaacgatgcgaatatccatggagtctagagagggtgttaagcaattaatgtcacgctttatggtggtattcgattctacagttggtgattatgtgccaggggcatataacagcaatgacaaggtagctgtacagcaaattactattgatggaataactaacacagtaacgcaacagggcaagaacatcaattctgtaacatctcgcgttcaaacagccgaagggaatatcagcacagcgactgataacatttctggattgcaaagcaagcaaactcaaacagctaatcagattacgcaagaaataactgatagaactaagggtgattcaaacacattgcaaagctccaaagactttactcaaagctctatcacgagtgcagttaacggattaaattcaactatatctcaaacagctaacggtatattggcacaggttgaatcaaccaacatggtagttaattcagagttcgacccactaaacggtaccttttataggctaactaatggtggttcaacgggttcacagttagcagaagcatggagcgccacaaaagctacagggtttgcagattggccggttgtaaatggttccagggtagtgtcttatgcagtaggtacctggtattcaagtgcattagtatctactagtgctgggaaagcgtttagtgcatcgattgttgcaggacgttcacccgcacctacggtatcaacagcacttgattatagaattgggttttgggattcaagtaggaaactgttaactacagccagtgcaggaaacattatagatggaacagcatataaaggcattcaaaagtatgtagtggaaaataagacagcacctgctaatacagcatttgtatcagttattattgcacactcatcagccaatgctactgattatataactagaccatctttgaatacgggggctaaagcctcaccatacacaccaacgtatggcacgtctagcagttctacagtattatcactgtttaaagacaattggtctataggtatcactgataatatcagtaaaattaccagtggcattgttggtaatgcgtctcaaatgagcctcattagtaagaatgtgacgattgatagtcctaatactcaaattaagggtactgcatggatacaatcagcaatgattgctaacggtgctataggtagtgcacagattggtgatgcaacaattaccagtgctaagatagctaccctggatgtggctaagttaacgggtaatgtttctaactttattcaaagtaactggaatgggttataccagtcagtgaaaattagtccaataggtatgactattagtacatcccaagggtctacagcgcagtttaatcaagatggattagtgttagagggtgctttaggtaccactaatgttctaaatgggcagatcgaattgattagcagcaaaaatgagtatctgggtacattccagcatgaaacaatgccagaccatgacaacgtagattacctaatgattaagcttgctggatggcatacaggtaagtctacagacccagattatgacttaaattcagacggaactaacaccattagaggtggcgatggtattgggttcggtgtaactaacagcgtaggtacctacgacatgaaaatgtcgtgggattctagcctagtagctggttacaagggacgtaaagcagggtggcatgttgaagacatcatgacgtggcatcaaccaacttactttgagggtggttttgacgtagcgcaacaatttagttctacagatagaagagcattgcatatccaaggtgcaacattatcaaacgggcataaatggtttggcttctttgatacaccatcaaaagcgggctttgggacagatgataccaatgacgttctattttacatgaagggtaagagttacagtctctataccatgctaagcaaattaaatatgctataagaaaggcaaataaatgcaaccaagacaagaagacgtaattaacagcttattgcaacaattgactaatttaacttatgtaaacgcacagttacagtcagttgttgcgcaatatcaagcaaaagaacaagtacagtcagaacaagtagaagaggaaaataaataatgacaattaataagagtgtatcaatcaacgcaacatcacaaacaacagatggccaagcaattgcttactttagcgctaatgtttcagattcaggaacatcaagtaacatgacgattcaagatcaaactttgtatgaagctaataagtcacaagttcgcaaagataagactgattttgataatgctgtttatgaggttgaagatgctcaaacatctgcaacaacagcaggataatacaatacccctttggggtgtacatatttgatatggataggaggtttaaatggctactaaatatggatttgtttacattgaaagcaatgtaacagggcgtgaaaaagcgatcacgttagacaacaacagtgaatattatggcgttcaggcaggtagcccatccttggtaactatcacaggtagatgtaacgtctacccagaatggcagattatccaggatggcgcagtcataggcaaggctaaatttagcttatatctagctgataaccagaggttaatcgttagttcttatccagaagaccagtacgcaagagtgtataacacagatggcacgttcagtgatgttagtcaattagcagacttttcagttaacaactatctaagagtgccagaaggtacatcaactttattagcttatttagatgaaaatgcacagctagatgtgacattcaaagaagagaggttgatagtatgagcttggcacttgatattacagtatttgatagtgctaaattagttataaaaggtacctataaattattcagctatgatattcagatggatgccttaagtaatgttaccagctcattcacgattgataagaacactaacattatgacaggtgattatgtagctgttagaccaaataatagcacaaccttaatgtattacgggcagattataacagtagatgtagatgattctagtaacctcatgacgttaagtgctaactgcatttggaacttactaaatggtgacattattgtaggtagtaagagtggtgatagctatgaagctcatatattaaagctaataaacaactatattaactctaatataggcactaacttactcaataaggggcttactaactcgactaacacagcctttcaagtaacctcatcagatggaattagtacaagcaattttatagactacttaatacgtggattcaaactacataacacagtgtttgaagttacaggagtagggcaaggaatatctaatggtattcctttttattatccaaaaattgactttcatcaggtaaaagacacttggaattttaaaaatgatgtctatgatttcaataattgggtagttagtgattcaagaaacctacgaaattacaataacgagctttggatcgtagaccaggcgtcgacagacatggaaagccctacggtgttagcacgctattggctcactaaagatggctcgataagtaagagccttacagacagcgtggctaagcctacacaggtacagatatatttatttgataaaacagcgactgataaccctacttacgaatcaatagcacaaagtaatttatcagcaaacacttactctcatagtattcaatttagtggacaactaggaaacaacttcctacccctagaaaaagtaaagctagggctacaatcaaatatttattacgataatacacaatataagtcagttcttacagcttacagtatcgacagtagttcagaagtagttaatcttacctttggtaatctacgctttggacgaaatgacttgtttagcaccacaaattaggaggaatagtaatggccataacaatgtataccagtgatcgtgcttttgtcacaccgcgcgaagtggcatcagcacaatcagctttaggtggtgatacttcaggagtattaaaaagaggtaaggaattaaaaataacagtcaatggactaacagcaaccgttgatacagggcaagtaatcgttctggggcgcttagtagaggttacaagtcctacacaaatcacactaccagccaactcaaacggtaatctttgcatcgttattgacctatcaaaggctaacacggtacaaggacaagcagggcaaccaaactattacccaacaattaatcaagtatatcctagtgctgtaacaggtgatttagtacaagaagaccttaacaatggtggctttatttatgaattaccattagctacatttagtactactgctacatcaggaacagttacacaacataacccaatgttgaatgacagcggatggctaaaccttgatattgctagtactggctcaaaattgtggtctgataatggtgccccttgttacgctcaatatcgtgtaagggacaatgttatgttccttagatggcgtggagtagacgtatctaaggcaaacaatggtaatcaaatagggcgcgttccatggagcctacgcccagacgtggaaattgcatcagcttctagtgatattggtgctacttcaatctaccctgttatcagttacgtgaatgacacaactacattatgggtaagggttgtagataatcattgtggtaatttggttggttctatgagctatccattgccagtaggtcgttaaagaaaggaggtgaataaatgcaaatgccacatgatttgttgagttggctaagtgtggggtctattcttctgggtggtttgtggtgggtattgaagaataccattgtgaactcaattaatggattgaggacggatatcgctagcttaaaagacgagctaaaaatatctaacagtatcacggacaaccatgagatacgactcactaaattggaaacgtggaaacacgataaatgggaggtttgaaaattgaataaattaaaacgatgggtagtcgcttcaatcggagcggttgccttttttggtgcaatggttactggtgtatcagccaatactaatggtattgatgttgccagttatcaaggtgatacagcaagctacttcaactcatttaagcaagttggcgacaactttaccatggttaagctaggtggacgaggaggtggtgagggtgctcattatagtaacccgaaagcctacgcacaaattcacaacgctgatgcagtcggtatgcaaacgggtggttacttctgggcacaagtaggtgactcggtgagtgaagctacttattcagctcagctagccgttcaggatgcacaaaatgcagggttggctaaaggttcatacattgctatggattatgaagcaggtgcaggtgcgaataaggccaacaacacgacggctattctagctttcatggatcagatttatgcttctgggtataaacctatgttttatagctacactagctatgtgaattcatatgttgatttgagtcgtattaatgctcgctaccctaacgctttgtggttggcttggtacttaactacagcgcatcaagcaacaccacctatgcaatatttccctaactattccaacgtgaagatttggcaatatgccgataatcactacggagttgacgggaacgtgatggtcgttggttcattggataacaacaagccagctgaacaagttgcatctaagcctagtcaatcaactaacacaccaagtacaccagctaagactcaatacgctacatttagtggtgtatatgttgctgactattggacacaatacaacaacaaaatgtatggtgtgaactttgatatgagcatcaagcctattgattacaacaactatattcctatttcagctatgacattgactgacaaatatggcaacaagttgcgcaatcaatatatccaaggtaacaacggacgtatggagtacttcactttgaacgggaaatacaaggtgattagccaaacagctacaacaattaatgttgaaattggcggagaaccagtcagcatgatgaaggcgtttgccacaatcaaataaggagaaataatgacatttaatgtagattcaaatatcgcaattttagtaattgtatggctagttgttcaagtcattaaaccaactaaaattaataacaacttgttgccgctaatggctgtaatcattggagcgttggtagcgataggtctatcgctttacaccaaagacacaaaattagtgcaagacatcgtgctaggtgtatgggccggatttgcttcaacgggattgaatgaaacagccactaaatctatcacatcaattattgatggctttgctaatggatttgggaagtcagaagataagaaaactgaataaaataaaaaagccaaccggattagtcctggttggctttttttatgttttaaaatatagaattcactttataaaaggaaattacaaacaaaaaaacgcacaccgaagtgtacgctgagttatttccacaatgtggaatcttgaacttatattcttgaatctatgatcttgaatttaaaaacccttaagaattaaagaagaaagaaataaaacctaacaaatatctttgttcaattagcaatattaaactattttaaatgatatgtcaacacttttgcataatattgttgaataataataaaataaagagtaacatgttttttaaaatacaatggagagaaataatgggaacggtacctacaaatttatttgattttggctggtttgctaaaagtgattatacattcgatgattacgtaaacgagctttctagtaaagctataacggagtattggggaaataataacaaaatactaaaaaactatttatcttacacatttcaatacctcgctgagaaccataatgtttctccagaaaaacactatattgtttgtagcagagatcaaagtgccatttcctttaataccggtttgtttgatgataactacgaacctatttttgctttttttaaaaagaactaccaacaaaatagacaaccatggttttttataggttttaaaatagcatctgatatcgaaatgaacgcatttaatgttttgccgaaaagaaataactattttaaaaacccagaggagttgattttaaacccagaagcagagataagaattaatattccgcacatattaggagatgaaagaaataaagccagattgccagaaacttgcaaccaatattcagatacagttttgagatctttattagacggagccgttgttagagcaaaaagaaaagtatccgcaaattatacaatggccgttccccaattttatcaacattcgttgcagttgctcctcccgttagaaatagaaggaacaggagttcctgatatggcactagctgtttcgtttaaggatggaatatattcgggtagaaccgctcttactttagagatggcttataataatgctaggttgataacaaaaccagaatcaaactgggttaaaccagaataagttatttgcaataaagaacgcatgttcgtataatgtcatagaggtaaaattatgaactatgacgacaaactaatcgaagaaatcaagaagcgattcacgaaacagaagaacacactgtattgggtgcgaatcgcgtaccaaagatactccaagcagttaaacgtgttctttgaatacgccaaaataggtatggctacacattcagaacaaataggtaggtacgttgaatctgaaaaggatcgtatgcccgaattagcgaagcgtatcaagaaagaaacaaacgtaaatgtggagcttggtgatttagaataatatgaatttttaattattgtatttgatgattttatcagttaaaataatcatgtaattgtagaaattatgattacatggcctgatagcattccgagaagctttacccctatcgggtctttttataataaaattatataaaagaaattttttaaaaattaaagcgtataattaattttaagcctaacagactttcctcgctctatacaaaatcattacctgagttatgatttatcgtcggttctctgttaggcttttttatttgcataaattaatgcaaacatagtaaaatgaattatacttagcaggcgtgtagactccatgataatatcctccaagatgattatcgatttattatgaatcctgctaggtttttatatagatgaaactcgttaaaaaaccggctagaaattaatctagtcggatttttatttgctacaaatttgctacattagctctcataatcctttaacacaagctagttaatatccccctcagcgcatatacaccgttttatcacaaatgttgataggacggtttttgtttgcttaagtgttgctatatgtaggtgttgggaagtgatattgtagttcttcttaaacttttacaaatcgtattttcgatttttgcgcttttttgactaatgaaacaccacgcagtggttacatatctaaacacgtttttccgctgaagagatatccccaatagatagtcttcacttgaaagtacagattattcccagcaaaatttttttgataaaagcattcaagaaattgaagaagtgctcacaattaagaataagtgatttacaaagaactatttaaatgttgtagggttcatttaaagagttttttgttatacattcgagacccgctttacgttcatctttgagtatgatattgaaatagtcaaaaaagtgcttgctgtagtgctctttaaattctcacaagatgtcattgcgggttgtggaagagattctataaaaagtcaccaacttataattcacaaatgtgcacaggattaaaactacttagtaactgttcgggtcatcctgttggttttttacagcctttagttgcagtgattaacgcttctctttggacagggtatggttggagtaaaacatataaagattggccaatcataatttctaacgttccaggcatcttttttggattagtaactgtcattacaatttatattcattaaaataaggcactacggtgctttttgttttaaaattagtttgggaggattatgaatatgtgattatttactggtatgatgttagtaaataacacattgaaggtgacgatatgagtgatgaagcttcagcagaatcatggttaatgattggtgtatttattccaattattttggttcttatagctgctgttttgttccattttttaaaaaaatagtttaaattatgccatttttaaattagcacaaaacgctattaaaagtgcttaatcatgaaaagacaacaccaaaataaaaaccatcaataatgttgatggtttttgattatttataagcattgtagccgtcgctataccctttaatcatatctggcatttcattagtaaaaaacacaatgataacagcaaccactagaatgataacccatattttttgggctttggtgaatgttttgaataaaggtttcaaaaccacaaacgatccgatagcacttacaaagattataagatgtaataaagaaacaataaaatttaccatactttccccctagatgtatagataaattatagcactaacaccgtgaaaagaaagtcttaaataacatgaaaaagtctaaagaacccgagcaagattatttgtctggtttgaagcataaagatactactgataagtattgcgcatctataagtccagtcttggaaatttcgttactggaattttgatgatgttgaaagcatcaaaatttatctagtgacatgagagcaattggtattaagacagctaataaaactgaaagcagctgattatttctttgtatcaactattatcgggagttgcattcttagcatagtcattgaggaaacatgggttaaagttttggtgacagttcttataaatacccccttggttaattatcacgttatttataaaaagcaaaaaacgcacaaatgaaatgacacaaaatcaggggaacattataaaaaatgtttccctgattttaatgaacacaatctttaaaaatgtttataaaatcacaatgtaagctgtccagaagttaaacggcagtcacgaaagcaattagaccaaatattatgcctggaaaattagctaaggcgacaggtatgtcgcgatgattcttttttagtgcgtagataacccacaaggtacaattgatagccgccaccagtggttgtaaggggttcgccttagaaccagctagattatctgcaatttgagggatatacgaaacatacattaacacagccatgacggtcgcaatccagcttaggtactttataaaatttgtttctttcacgatattcttctccctttttattgtacgctttaataatacaacgaagtgaagaaaatcacaacttttatcatattgatgaaaagtggtcgcaatttttaccttaaaagttgtaattttagaatatttgtcatattaatttgtaccttttttagaaatagtgctattataaacatacggtgatcttttctatattctattttatttcataagatccttattcatttcattattgggggatcaccatacatagacggggatggggataatcatgtctgttaaatacaatagtttaatataataaactatgtaacgagtgcctgattagggtacttttttattggaaaagattagtgaatatgctgtcgctgcccgtgacatgaaaagtaatatttcatttaatttcaatatgttatgatttactaagagtgaataattagaatatctgattggttaataattactaactgaaattgatgattgaagaatatagcaaataaagtgggaataaccataatattttagtcaggagtaaatttatgtcaaataaaactgatgcacgtgttgtacgtactaaacacattattcaagctgaaacaattttattactatcaactcagccagatttttctatcacaaccctattggctcgtgcgaacatcacgcgcggcacattctacaaatattatcgtaacaaagaacatcttatatctgagattaatgattccttgattaatgacctactggaacatacgcaacaaacttttaaaataaccgacatgatcaatacggttagtaaacaagcggctttttataatgctgttttgaaccatgatattgacaaaccatttagtgatgcactatatagtaggctgcgtacccaaatggcaacccgtaccagtgagttaaacgacgaagaacgacgggcgcaacaatatcaatgggaagttatcaatgctggcttttgggccatcatggctaagtggttagcggataatatgaacatttcgcaatctgacttgtttaaagaatttacagagctatggcgaatcaataccaacacggttgccagcaacggattgaacctattcgactttagcaatggtaatgaactgatatgatggtcatctgagtcattctggattatttgaagctcttttgaaaatcattgactcgatgatctatttttgttataattaaacggttgttagcatagctacaaccactcagaacaggtcaaagcatgctcgggacaagggcccgaccgcctgtgatggtgagtctaagtataaggagaaaccaataatggcatacgcaattattgtaactggcggcaaacaatataaagtcgctgaaggcgacacaatcttcgtcgaaaagttagatgcagaagcaggtgaaaaggttacttttgaccaagttgtattaactgattcaaagattggtacaccttttgttgaaggtgcaaaggtcgaaggtactgttgaaaagcaaggcaagcaaaagaaagttattactttcaagtaccgtgccaagaagcattcacatactaagcaaggccaccgccaaccatatacacgcgtgaagattgattcaatcgcgtaatcattacttgtaaaggagaatagacttatgttgatgaatcaagaaaacttgcagatgttcgcgcaccacaaaggtggcggatcttcagccaacggtcgtgactcagctggtcgtcgtctaggaactaaggttgctgacggacaagacttaactgctggttcaatcatttaccgccaacgtggtacgcatatttatccaggcgtaaacgttaaaaagggtggcgatgacacattgtttgctttgacagacggtgttgttaagtttgaacgtaaaggtcgcgaaaagcgtcaagtatctgtttacacacgtgaacaatacaatgaaattgttgctgctgcaaagtaagtaataattattgaaaaggctaacgtattatgcagataatatgttagtctttttacttacaaatgattaacgttgcagatgttataattaaatcagttataggaaagaggatttttatgtcaaagtactatgaggcgcgtattgctaaattgcagaagctactggccaagcttaacttggacggtatgattgtttatcaaggttttaatacaaaatatttaactggatttgaaggtggcacaggtgatggtattgtagttgttggcaagaagaatgctcgcttaattacagatgctcgttacgaagaagactacaaaaatagattacctgagggtgttgattttaaagtcacacgtgattattacggcgttgccgtagaaacagcgcaagaatttggtatcaagaagttggctttcgaagcaagcttaccttatcacatttatgattacttggatgaattattgccagcagatattgattttgatgcattgccaaaagctattgaagtgttacgcgaagtcaaagacgcgcaagaattagaagctttacgtaaggcggctaacgcttcagtgaaagcatttaaggacttgctaccctttataaaaccgggtaagacagagcgtgaagttgccaatgaattggatagactacaaaaaatatatggtgcacaaaaagcatcatttgatacaattgttgcctctggatatcgatcagcattaccacacggtgaagcaactgacaaagtgattgaaaatggtgagttagtgaccatcgattttgggtattatgttgatggctatacttcggatgtaacacgaacaattgctgtgggcaatgttagtgatgaactgaagactatttatgaaattgttaaacaggctaatcaaaatgctattgatgttgttaaaccaggaatatcgggtagcgaaattgataaagtggcacgtgattatattacagaacatggctatggtcagcaatttaatcatggtggtggtcatggcgttggtctggacattcatgaaggtccagcaattagcccacgttctagtgatgaaatgcaagttgggcatttgctaacaattgaaccaggaatttatctagctaatcagggtggcgtccgtattgaggatgacgttattgttacgacagatggttttgaaaatttgacagcggcgttgcctaaagatttaatagttattgaggaatagaatggcacaagaacgattagactttttagtattttatcgaggtaatttggttacgggctttgattacatatacgtaaaacgtcaagaagggcatgctttctggcagagtgctctcaaggcgcaggaagcaaaagatattttagataaggactttatgttttataatccacatttaaatgacaaaggggagccttttaattggcgttatcgtgaggattgggttgatatgacaaaagtttgggatcatttttcagaggaggcaatggcctatattacgacttggatgagtgaataccgtggcccatcttatgatgatcctagtaaaaatgatgaatggggtgttcgtttcaaagtaccaggggaaaaggagcaatttatttggggattaaatgcttttcctgcaaatttggacgattttagtcattttttgtatcgttttggacaataaaaagacgtcggttgacgtctttttacgtagataggtgtaaaattaaaatataaatcatttcgtgatcggctagagaggaaaccaatggggacaattcacttattacatacaaatgacattcattcgcatttcgaaaattggccgcgcatatcacgctatttattagcaggtcaggctaagtatgatgagagctttacatttgatattggggatgcaatcgacaggttacatccattgactgaagcaactcaggggttgagcaatgtttcgttaatgaatgatgtacattatgatggtgtgactattggaaacaacgaggggcttgttttctcacatgacaccatgaatcatttatatgataatgctaactttgatgtattattggctaatttgaaggaaatgcctcatgatacacaacctaagtgggctaaaaattacaaaattttgaccactaaagataacacgaaaataggtgtcataggattaacagcgccataccaactaacttatccggcacttggctgggatcccattgctattgatgagacgttagacaagtacttaccagttttgcgtgatcaagtagatattattttgttactctctcatttaggtttgccaacagatgagcatattgctcagaaatatgacgtagatgttattatgggtgcccatacgcatcatctgctaccgcaaggtaaaatggttagtggcactctgttagcagcggcagggcgctatggcgaaaatgtcggtgatatcacattaactatcaagggtcatcgaattattcataagtcggcgatagcaacacccacttatgagttagcagaaaacgatgatgattataaaacagttcggagttggattgctaaagggcgagaattactcgaacaacagtacgtgtgcacattgcctcgtgagataacatcagatgaacaagtttatgatggcttacgtgctttgaagcagtattataatgtgccagtgtcaatgatttctacagggatgtttagtgaagagttaccaaaaggaaaactaagtcgctatgaactactagaaagtatgccacacgcaattaatccaatgctaattaccatatctggagaaaagctgctctccttattgcacagtattgacgaacagataacgaacttagcgcagtatcctatgaaaggtagtgggtttcgaggtaaaatttttggttatatgcgctttgatggtattgatcgacaaaagaatggtgaagttttgtataatggagaggcgatcgataaaggtaaattgtataaaatagcgacactcgatcattacaagtggatttcttttttcccagatgtagcgcaagcgccagcaaaaatagaattaaatctacttttgcgtgaacttatggcaaattattatgcgaataaatataaggataactaatggatcacgacacactaaaagaacgtacactcaaacaacaagaggaacgcaaagggacttataaagttaaaaagctgggtaatgaggttgaaattgaccgtttgacgctagaaatagttgaagactttaaagatgcctttgatgaagataaactagccatacgatacacaccgctattagctcagtatgattatattgtaggggatatttctgctgaacaattacgcttgaagggcttttataataataataaagcagtgaataatcatgataaaattcaatctttacaggattatttgtatgaatatgtgaattttggcgcaccatactttgttctagaaaatattaatcctcgtgttcctgaggtgaacgagcgttccaaaaataagaataaaagtaagcatcatcggcccgtaactcataaaaaagaatcaagagcaaaagtggctgcagctaaacaaaaaaacaagaaatcatttgtgattaagcaaaaataagagccattttaggctcttattttttgatttattgatatatagaaacaaaaaaagctacaaccaaagttgtaacttaattagtagctcgtgagagaatcgaactctcgattctgccgtgaaagggcggcgtcttaaccacttgaccaacgagccatgatcaatttgttatttgcttgaatcaaacaactataatagaataacaagaatctgcagcgctgtcaatactttttaagtacaaaataaaaaacgtcactaagacgtttttttagtatattaatcaagtggtacgtcaactgcccagccttcgggaccttcttggtcaccatattggatggctgtcaaacgatcgtaaagcttttgtgtccaaggaccaacttctgtttcagaatagaatacgtgcttgttaccgttatgtgtaattgaacctacaggagaaattacagcagcagttcccattgcaccagcttcagcaaactgatcaagatcattgattgaaatagttgtttcttcagcttttaggccaagttcttcagctacttgaagcaatgaatatttggttacagatggcaagattgaaggtgactttggtgttaagaagcgaccatcctttgtgataccgaagaagttggctgatcccaactcttcaatattttcatgcaaacgaggatccaagtaaacaacatcagaataaccagcagcatgggcttcatcaccagcaagcattgaggcaccatagttaccaccagccttggctgcaccagtaccaccgtgagcagcacgatcataatgattagtaacgtaggctgttggtgttaatccacctttgtagtaagcaccaacaggagttgcgtatacttcaaagacatagttatctgctggatgcacgccgacaactgggccaccaccaaattcaaagggacgtagataaagtgttgcgccagttccgtaaggtgggatgaaatcttggtttgccttcgtaacttcttttaaagcacgcacaaaaagttcttcggggacgggagccatcatcaaacgagcggctgaattttgtagacgctttgcattacggtcaggacggaaaatgtttgcaccaccatccttacggcgataaactttcaacccctcgaaaattgtttgaccataatgaagtccggttgctgcctcattgactggaatgtttgagtctgtttcgagaccaccttcgctccacttaccatctttataataggcacgaaaacgataaggaaggtcatggtattcgaatcccaagttgtcccaatcaaaatcttcagctttagcctttcgttgttctgacataatacgtccttctttcttagaaaaatatgataaaactactataacgcttagaagggaattgtgcaatagctaacgatgaatctttttaatgttaattatttagaaatctcgtataattaaaggtagtgctgaagcctatgaattgggtcattgcacaacatcactaaaattatttatcatatcagtgataaatcaagtattattggagatgaattaaaatggcattattactggcagtgaaagcaataacgcaagaaaaccgtgaatttcttgcacaatatgatattagcgttgtgacaccggacacgattaccgatgagcaattacctgaggtattgataagttatgcttgggatacagaaattgggcataaaatccttgctaacccagaatcaaaattaaagtggattcaggcgcaatcggctggtgttgactacttacccttgaaaacactacaggagcgtcaaattactgtgacaaatgcgagtgggttaaaagcggtacctatagctcaaactgttttgggctatattctccactttgctcgtggcttaaatgtttattctacacggaaacattgggagccttttacagatcagtatttgatgagtgaattaccagttttggtgtttggtactggtcgaattggacagcaaattgctcacgctgtaaaatcattgggcggtgtagtttttggtgtaaatactacaggtcgtccagttgaaggattcgatgcaacttatgcgatttctgactatcaagaagcactagctaaatcgcaagttgttgttgacgggttaccagggacaaaagaaaccgaaaacttttttgatgagcattttttccaacagtttaatcaattgtttttgtttatcaatattgggcgtggcacaactttgaatcaggacgacctactttcagcaattgatgattctcgtgtcaaatatgctgcattagacgtcacaacacctgaaccattaccaatgaatcatccattatttgagcggccacaaatcttattgacacaacatacaagttggggtgaacaagaaagtgctggtcgtgttggtggattatttcgtttgtttgaaaaaaatgttccttcatttatggctaatggtacgttcgttcaaaatgttgttgatctaaataaaggatattgatattcttttaaaaaagcagtaagactctaatttagagtattactgcttttttgtttatattaatcaaaatgccgccagtctttatctagtatggcacgtgccacaaacaaccccagtggtaagaacatgataattaaagcagccttggtcatccatagcgcgccaataccgatttggttattaccaatactatatactgcacgatagatatacaaaccaggcaccataatgacgatggaaggaacagttaaggaaattcttggataaccattgtaacgattgaccatcgatgcgattaatcctgcaaccaaagcggcaaaaaatgccgccgctgcgggaggaatagtagttaaatcgactagttctagtcgcagagtgttggcaattgcaccaatgcatccagccacagcagccatttttttcgagctgttaaacatgattgagaaaccaaatacgccgcaaaaactggctgggatacgaagtaacatcagtgtgattgacgataagccaagtggcaaaaaatttgctggtctaaaatgaaccagcgaagcgactaaccaaccaactaatgtggcaattagcgtgatcattatggcataagctagtctttccaaaccagagcgcatgtctaatttcgagatatctaacatactagtaataaaaggaaaaccaggaataacgaagagcatagccccaatatatccggcttcatgctgagctaaaatatggaaataaaattcgaatattctaaatgcaaacatataggtgatgcatgctgtggcaacactgatagcgacgcccacaatggtggttatagcatgtttacctaaaattgaacggacatagtttccaatcccagcaccaataaatgaacagatcatctctggaataccgccgccaagtaaaaaaatgaacgcactacatgctagagcagcagcaaggccagagatgatcggcgtatattgctttggtcgattttgaatgtcgttaatcgtatgatgaatttgaccaatagttaaagatgaaaaatcatcttggatattgttaacgaaatgctctaaaatatttagcttgtcggtatttacacctgtatttggcagcgataatacttgagaataactttgattattgctaaaacaagtatattccaatgaaattaatccaatatcggcagagcatgtgaggtctagttttctagcaaccttattcattgcatctcgcactcgccatgcgccagtaccgcaagacaacatgagaataccaattcgaccaacaattgaggcgcgttcctggagactagcatttttagctggaatattttcgcttttaataaaagtggcccaaggaatcgtcatatgatggcgtaaagacaaaggtattttttttaacacgtgtggattactattcttgtccattatttcctccaatgaatcaatgaaattaatacaacactcctaattccttcattatagttgcagttgctgtcgtattcaagctattcaatagtgatgaataaagggttaacaagttctttgcgtcccaaaagtagatgaactccgataggtaagcgtttacatttctgaacatcgatgataagatgtgtgtataatttggcagaagaattctcgaggattaaatatgacaagtataaaacaaatattagcacgccatgattgggaaaatccagtggtaacgaattggaatcgattaccactacacacgagtatgagctacgctaatgaacgagacaaacgagaaattaaacaaccacgaaaaagcctcaatggaccttggcagtttagttattttgaaaatctatcagacattgacgaagaatggcgaaaaaaagacttgcctacgtcaaaaattattcatgttcctagtaattggcagttgcagggggactatgatgttcctgtttatacaaacgttacttatccatttccagtaaatccaccgtatgtgccgactgagaatccggttggcgcttattccaaaaaggtctttcttgataataaatggttagcagataacacagaatcacatgttgtctttaatggtgttgggtctgcattttatctttgggttaacggagaatgggtcggctattcggaagacagtcgcttaccagcagaatttgacatcactgaagaattgcgagctggtgaaaatcgtatcgcggttttggtgttgaagtggagcaaggggagctattttgaagatcaagatatgtggcgaatgtcgggaattttccgtgatgttgatcttattcgtgttccaaaaacaagatttcaggatttagcaattgagacaaaactggatgaagatcttgatgacgcaactgttgaggttagggcacaattagttggaaattcggcggataacttgagtgtgactgctgaattattttaccatggtatgagcttgttcaaagcaacagaacaatttggtaatcgagtaatcgacgaacgtggtactaatgatggtcaagttagtttagaattaccagtaaaaaatccggcattatggtcagctgaagtaccaaatttatatgatataaaagtttctttgcacgatggggaagaaaactatcaaattgaaaataagaaagttggtataaggaaggttcaaattaaagatggtttactgactttaaataatcaaccgttattaattcgtggtgtcaataagcatgaatttaattcaaaaacaggatactatgttgatgaaaaaacaatgattgatgatatccgtatgatgaaggagcataattttaatgcagtaaggctttctcattatcccaacgcttcacgatggtacgagctgtgtgatcaatatggattatatttagtagatgaggcaaatatcgagacacatggtgtcaagccaatgaattaccttacaaatgaccctaaatacttacccttgatgatggagcgagtgacacgaatggttcagagagactataatcatccatcaattattatttggtcgttggggaatgagtctggctatggacataatcatgatgcaatgtatcaatggcttaaaaataccgacccctctcgtccaattcagtatgagggtggtggtgctgatacaccggcaacggacattattgcaccgatgtatgcacgtgttgaccaagatcaagtggaagaggtcaactcaaaatgggctattaaaaaatggattggcttgccaaaagaaaatcgaccactgatattgtgtgaatatgcgcatagcatggggaatagtttaggtggatttaataaatattgggaggcttttgaaaaatatccaagacttcagggtggcttcatttgggattgggtagatcagggcctgctcacaaaaaataacgaaggccaatcatattatgcttatggtggtgattttggtgattatcctaatgatcgccaatttagcttggatgggttactatttcccgatcgcactccaaaaccagccttgctggaggcaaaatactgtcaacaatatttcgctttccaacttgaaaaagatccaactggaaaagttaactatatgacggtctcaaataagcatttattcaaaacagtcaatgatgcaaccttaatttatcaaattttgtcaaatgatcaggtgattgagactaaaaaaatcaaactcaatttggcaccccaaactgaagagagagtcagtttgaatttctccgataacagcaatgaagatgtttatatgaactgccagattgttcaagatagcactgatggccttatccggtctggtacattactggcttacaagcaatttattttgagaaataaaccgataatgattagtgacgtacgatcatctgatgattatgaagatttccttataaatgatgcgacagactccttgtccatttctttagatgatgctatctggcagtttaataagcgtacaggttggttatctaattggataaagaatgggcaggaaaaagtactgactccattgaaagatcaatttagtagagcagctttggataatgatattggagtgagtgaggtaacaaatattgatccaaatgcttggtttgaaagatggcaagcaacagggttcaatcacttgaatgaaaagcttgtgcaattcaattggacagcattaaaagatgaggtacgaatcacgacacaacatcaatttttatcaccgattgatcaacatatcatgtttatatctagtaaagaatatcgaataaatcatgttggtgatttaaaagtgtatgtggatgtttggcggcaagttgccgatccacaaccagcacgtattggattgagtgttcaaattaacgcaacgactgacgcagtgacttatagtggattgggaccaatggaaaactatccagataggcgttcagcggctattcgtggcaaatgggatgcttccttgaaggaactttatacaccgtatgtttttcctagtgaaaatggcttgcgtactgaagtggcgtatcttaaatttgatcatcatgtcattcgggcacttgaacaacgtttttcatttaatttgagtcaatttagtcaagcgcaattgtcagcagtcacgcatcaacacctattaaaacctgaagagggtgtttggttgaacattgatggctatcatatgggtgttggtggcgatgattcttggtctccaagcgtgtcgccagagtttttattatcaaacgatcattatcattatagtttttcgtggtcaaatacagaaggagaagcaaatgtatagagctaataaaaatcgttacgagaaaatgatatataacagaattggtaacagtggattacagatttcagctattagtttgggcctttggaataattttggtagtgtggatccctacgaaaaccaaaaggaaattattcaccaagcttttgatttaggtatcacatattttgatttagccaataattatggtcctataccaggaagtgctgaagaaaatttcggcaagattatggctacggatatgaaaccttatcgagatgaaatggttattgcaagcaaggctggtcacgaaatgtggccaggcccttatggtaattggaattctcgaaaaagcatcattgccagtgcagatcaaagtttaagacgcactggtttagactattttgatattttttatagtcaccgtcctgatccgatgacgccacttgcagaaaccgcacaagctttagaccaattggttcgtcaagggaaggcgctttatattggtatttctaaatattcgagtcaagaaacacaagagattatcgatatttttaaagaattaaagacgccattcatcattcatcaaccacgttataatatgtttgatcgtaaagctgagcgaggtttgtttacgacattaggagaaaataaaaaaggtgcggttggatttagctccttagcgcaaggattgttgtcagataaatacttgaaaggtattccaaataattcacgtgcgaacaaagtaacaatcccctttttgacaacagaaaaagttgaaccaacaattaatacggtgcaaaagttgaatcaaattgcacaaaggagaggtcaaacgctaccacaaatggcacttgcttggaatttacgaattcctgagttggctagtgttttgattggtgctagtaatccaaaacaggtcatagaaaatgtcaaagctttggacaatctaccattttcaccagaagagttgcttgaaattgatcacgcattgagcgaatatgcacccaatcaagcgtaatagtttctttcattctggattattccaatttatctaaaagatagaacccaacgtctcgccggcgacgggtttttatttttcaataaatatcacaaaacaacgaaaaaaggatacaaattacactttatttgtaaacgcttacatagtattgttaatacataccctgaacttaataaaatataaggagtcgaaagatgtctgataaaatgaagcaacgtttttcatacgcttttggtgcattcgggcacgatgcgtattatgtaacgttatcaacatatttcatgatttttgttacaagcacactatttgcggggagtgataaggcgactgagtccaagtatattggtattgttacctcactagtcgtcggtattcgcttagtagaaattatttttgatccgattattggtagtattattgataatacacgaaccaaatttggaaaattcaaaccttggttagtgattggtggagttgtctcgggtatatccttactggcaatcttcacaaactttttcggtttatctgttagtaacccaacactctacctcgtactgtttacaattgtttttatcattttggatagtttctactcattcaaagatattgccttttggtcaatgattccggcgttatcaactgacaccgcggaacgtggtactttagcaacatttgctcgctttggttcatcattgggtgctaatggtacaactgccttggttgtacctattgtggcattctttactgtgctcacgggtggtagtggtaaagagagtgcaactggctggttctggtttgcattaattgttgcggttttgtcagctggttcagcaatagtaacagctaaattttcaaaagaaaacgaaaccgttttaaggacacaagccagcgaaaaatacaatattattgacgtttttaaggccatccttaagaatgatcagttgctttggttagcactatcttacatgttttacgcaattgccaacgtagcaaccacaggcgtgctgctgttttattttaaatttgttatcggtcacgtaacagagtttgcgatggttggtgtgatttcaatgattactggtataattgctgtgcctttattcccattcttggccaaagtaatgacacgtcgttatgtgtttgctagtggtattgccttgatggtactggcatatgtcatgtttacaatagccggtagtaacttgtggattgttggccttggcttagtattcttttatttcccacaacaacttatctttttgtcagtgttaatgacgattacagattctgtggagtatggacaatggaaaaatggtcagcggaacgaggccgtaacactgtcattacgtccattattagataaattagctggcgcattttcaaatgctattgttgggtttgttgcaattgctgctggtatgaccggaaatgcaacatttaatgatataacggccagcggcatccatacttataaattatatgcattttatattcctgcagcattgatgattatttctttacttattttcatgtttaaagtgacactaactgaaaaaaagcatgcgaagatagttgcagaacttgaattacgctacagcaagaagtaattagtataatttgaaaggttgactactcatgaaaagaattaaggcactaaacacgaagtttgctgaaaagtttggccctcacgaaacccaacagtatttttcgccaggtcggattaatctaattggtgagcatacggactataatggcggtcacgtttttccggctgcaattacctatgggacttacggtgttgccagaaaacgagatgatgatcgtattttagtttattcggttaattttgatgaaaaaggcgtagttcagttagactataagaagcttgattttgacgaaaatgatgggtggaccaactatgttaaaggcgttatcgtcaaattaatagagcagggttatgtactcgacacaggatttgatctgttggtcgagggcaacattcccaatggtgcaggcctttcctcatcagcgtcgttagagttattagtgggtgttgttttagaggatttgtttgatctggatgtttctaggttatcattagttaaaattggtcaaaaagttgaaaatgaatactttggtctcaatactggcattatggatcagtttgcaattggttttggtcaagaacaaaaggctattttgttagacacaaatactttgacgtatgagttggttcctattgttcttggtgaatatgcgattgttattatgaatacgaataaacgtcgtgaattaggcgattcgaagtacaatgaaaggcgcgcacaatgtgaaactgctttaaagttattacaaacagaacttaatattaactcattaggtgaattgactgatgaagaatttgatgccaatgttgcattaattcacgacgaaacactcgtaaaacgagcacgtcatgcagtttatgaaaatcagcgcactttaaaagcaaaaaaagcgttgtccgacggtgatttgcaaacatttggacaacttatgaatgattctcatgcctctctaaaagaagattatgaagttactggacttgaattagatacgctagtgcagtccgcacaaaaacagccaggtgttttaggagcacgaatgacaggtgctggattcggtggttgtgcaatagcacttgttaaagaaacagccatttccaattttgaaaacaaagtctatgatgactatatgaatgtggtcggctatgccccagaattttacgtggcacatgtcggcaatggcacgactaagcttaatgattaagtagattgctgcacagcacttaaatgtcctaaaatatcattgatctgttgccattctaatgagtgttgttcttggatactattgaaacttcttcgttttcgatatgcactaggtgtttcatggatgagctctgtaaatgagtggccgaaaacagaaggattgctaaaaccaaccttttcggaaatttgattaattgataactgggttgtttgaagtaattggcaagcttcgttaatacgaagtcgtaataaaaatttttttggtgaaatacctacatctcgtcgaaagagtcgtgagaggtaagaacggttgattttgatagcatcagctatgtcagtaatagatgtgtcgtaagtaaaattattattgatataggccaatgataatttagtgtattctgacatggggcgtattgttgcgttttgatgctcaacgacgttccaagtgttttccttcattagcaacaggagtatttcactagcaatttgatttaatcgcaattcggtttgtggcctatgacttgttaacgttagtgattcaacaattaatttaagataattttcaacagttgcgcaagagaaagtatcatggtgattgcgaaaaggcgagaagttctcaattaattgcgctgtttcagtaccaccaatggatatccatgcataatgccacggattattcaaatcagcttggtaaaaaattgtttcatcaggtcgtataaggaaaaagtcacctgctttcagggtatatttatgattcatggtaaagtaagttccttggccttctaagacaaagtgaagcaaataatgtgaacgttttaatgggccagaagcatgaccagaaaaagtcttactaacgccagagaaatcaaagaatatacttgattcaagcgtgtgctcattaacgatattaaataatgatttttccataatttaacgacctttttaaaaataaaatgatagcgcttccaacattagtatatcattttttaaaaatatttattgataagtgataatacttgttatgtgttattcaagtgatttattattgggttagataaatagtttaaacaaaatttttaattaaatgaaagaggtagcatatgaaagttacagaagaagtgtttggtacattgcctgatggcgaaaaggtaaccgcgttcacgttagaaaacattaatcatactcaagtaacggttatatcgtatggcgcgacatggcagtctttttctattgagcgatcaggagagaaaaaagaattgcttgttcaatttgatgatttagagcattacttagacaatccttttcattttggaaatactattggacgtgtgggtggtcgattatctaaaactgcatacaatttatccggcacgtcgttcacattaacaccaaatgaaaatgggcatgtcttacattcaagtgtaaatggttttgatacgattaactggcaaggaacagcacgcaacatgggtaccgctgcagaagttgttttgtcacatacgtttgaggatgaatttcctggccaattacagatgaatgtgacttacacactttatgacgacgataagttaacaattaagtttagtggtgaatcaacagaaccaacactgtataatcctatgacacatgtttattttaatctagctggaaaagatgctgatatcacaaatcatgagttgcgagtggcatctcacaaacatgttgaagtagatgacgaaacaattcctactggccgattggtagaaaatcagcattccaaatttgacttctcacagctacgtaaaattggggatgatcaatttgatgacgcctggttgctagatgagcagcgtgatgaagttggtgttattgtgcaagagcctgttagtggtcgaacactaacagtcgattcagatcggaatggtgttgttatttttatgactaatccaggaatcaaagatcacgataatgattgggcagaaaatgcaccattcacagcacttgctgttgaaatgcaaacattgccggacgccgtgaatcatgagggatttggggatattgtgctaccagctaatcaggtgaaggaatacacggtgacttataagataacagattaaatatttcacttgactttattcagccttacagctatgattatctatattagaaccgatgaattggaaaaattactgtctggacatgaagaaattttgcggaagatgcgagcaaaacaaagacgtaattttggacaccttggaggttgctattgatcaagatagctcgtggttgcgcgttaagcaattaaagtgacatgaaaatgttaaaatctaaggtggtaccgtgcatttgcgcccttaacgagaaatcgttgagggcgtttttttcggattttatacagcaagataaaaaataatggaggaaatacgtttacagttgttgattatttttggatagcgatgaatatgttaactaacatgtcgtatacttcaaaattctgataaaaaacactaaaaacgataacaactatggcaaaaccaatatttcaacgtcccaaaggaacagcagatttactgcctcaaaaaacagtacagtggcaacatgtagaagcagttgcccgtgttttatttggtgactataatttcaaagaaattcgaacaccgttatttgaaaatttcgaagtcttttcacgctcagctggtgatacatctgatgttgtgacaaaagaaatgtatgattttcatgataagggtgatcgtcatatcgctttgcgtccggaaggtaccgcaggtgtcgtccgagcatatgtggaaaataaattatatggaccggaatttgacaaaccatataaggcattttacatggggccgatgttccgttatgaacggccacaggctggtcgtttccgtcaattccatcaaataggtgcagaggtattcggatcagattcgcccgcattagatgctgaagtaattgcgatggtcattgattttttccaaacgcttgggttaaaaaatttgaaagttgcgattaataccttgggagataaggagtccagggatgcttaccgacaagctttaattgattatctgaaacctcattttgatgaactatctgcagattcacaagctcggttagaaaaaaatccattacgtgtattggactctaaagatccccgtgatcaggtctttgttgcagatgcaccatcaatcctggactttttgtctgaaaaatcgactaaacactgggaaaagttgcaagatattttaactgcattgaatttagactttgacattgacacaacaatggttcgaggattggattattataacgacacaatttttgaaatcatgactacagatgaaagtttaaaaggcgctgcaacgattgctggtggcggtcgttactctggtttggttgaggaatttggtggtccggaaacaccaggtgttggctttggtattggtgtagaacgtttgctggatttattgcaagcgcaaaatgttgctccaacagaggaacagaatttagacttttacgtagttaacatcggtgatactactgatgttatcgcaacaaaaattgttcaagctgttcgctcatttggttacgttgctgaacgtgattatttgtcaaaatcagcgaaagcacagttcaaggcagctgatcgtcatcatgccaaatatgtcataacgattggcgagcaagaacttgaagaacaaattgttaacatcaagaatatgaccaatggcgaacaaaagtctgttcaattgtcagagctttataccaatttaccacttatcatggatgcagaagggaacaaggaatgaaacgtactaattacgcaggattaattgatgaaacatatttagatcagacagtcacattgaccggttgggtgcaaaaacgacgtgattttggagacttgatattcgttgatttacgtgatcgagaaggtatcgtacaattaacttttaacgcaacaaatgcggacgcactagcagtcgctgaaaaagttcgtagtgaatatgttctaaagattactgggcatgttattgaacgtgctgaaaatcaaattaacacaaaaataaaatctggaacaatcgaagtcgatgtaacagaggcggaaattttgtcaacgtcaaaaacaccaccattttatattgaagatgatgtgaatgccaatgaagaattgaagctacagtatcgttacttagatttgcgccgccctgagatgcaaaaaaacttgcgcattcgttcaaaaattatgagtagcgccatgcattttatggatactcatgattttattaacatcgaaacgccagtactagcaaaatcaacaccagaaggtgcccgtgactatttagtgccatctcgtgttttcccagggtcattctatgccttaccacaatcaccacaattatttaaacaattgttgatgggtgcagggttcgatcgttatttccaaattgcccgtgccttccgtgatgaagatttgcgtggtgaccgtcaaccagaattcacgcaaatggacgtagaaacgtcatttatgacagccgatgaaatccgtgagttggtcaatgcatgggttaaggcgatgatgcatgacgttgtagattttgatcttgacacggataaaattccaactttgacatggcaagaatctatgaatcgctttggtactgataagccagatctacgtatagcctacgaaatcaaggatttgtctgaaacagtaaaaaatagtgaatttggtgtgtttgcaaatgctattaatggtggcggtgttgttaaagcattggctgttcctggtggggctgaccattattcacgtaaagacattgacaagctaacaaaatacatcgaacgtttcggtgcaaaaggtctagcttggatgaaagtagcgcaagaaggcttgaccggtcctattgctaaattctttgatgacgaagcacaggcagcattgattgcttcggcagacgctcaagtcggagatttgttgttatttggtgccggacgtgctgatgtcgtttcagcgactctagattatttgcgtcgtgaaacagctaaagcattagatttgattgatcaaacgaatccttgggcatttgcttggattgtggattggccattgtttgaatactctgaagactttgaccgctggattgctgctcatcacccattcacgatgccaaatgaagaagacttacactacttgaatgatggtgaagatcctcataaggcacatgcgcaaagctacgatttagtactaaatggttacgaactaggatctggatcaattcgtattcatcgtatggatatccaagaaaagatgctaaaggcacttggatttactcctgaaaaagcacatgaagcctttggatttttgcttgagggtatggaatatggtttcccaccaatgggtggtatcgcactaggattggatcgtttggcaatgctactagctggccaagaaaatattcgtgaagtgattgctttcccaaagaattcacgagctactgaaccaatgactgaggcaccaactcgtgttgaaggcaaacaactgaacgaattaggattgtttgttccagaagcagagtaattgttatcaaacaaattcgtgttattattagcttagataaaacttggagataaatgtgtgttatacattagattttttctcgtataacatacatattgattatgcaaaaaattgttcacaattttatgaaaaaccagtacgctggtcgtattggtggcgcggtattttatggtgtaatcgttgcctttgcaatgaattatttctggcatccagggcatatttattcctctggattcacaggatttgcccaacttgtttcgactttaactggcgatagaattcccgtcgctttagcgctagccttggttaacttaccaatgttagccgttgcatggtggaagttgtcgtggagatttgctatctttacaacgctagcagttttgctcagttcggcgttaattcctgtctttgataccacgcgtgttttaacaactgacccgttaataaacgctatgtttggtggcgcgcttaatggtatggcggttggtacagcattacggtatggcgttggaacaggtggtttagatgttattggtctcttagttaagaagcattacggctttaaaatgggaccaattaatttatctttcaatgccttgattatggtcggtgctgggctaacatatggttggaagtatgctttgtactcaattgtaggtgttattattagttcacgaatgatagatgttttctatacacgacagcagcaaatgcaagtgatgattattactactaaaccagatgaaatggtggatagtattcaaaataagcttcgacgaggcgttaccattatcgatgaggcgcgtggtggttacactgggcgggagcgttcggtgctactaaccgttatcacgcagcaagaacgatttgagttacgagaagcaatcaaagaggttgatgaacaagctttctcttctacttggaaaatcgaacacactgtgggacgtttctacgagccagagttatagttaataaaaaaggagacaacatcatgttgtctcctttttttgttctattttattttttacacggttactgcattttttgtagaaaactttcggtgagaaaggtaaccgaatactatcgtgaacaaaattgcgccgatggcagcaacacgagagtctgcttgaaagaacaaactggcgtaaatgctgacgaagaatagcaatgttagtggactagtccacttgtatcctggcatcaggaagccatctggcataaaattagttgattcacggaatttacgatgagcatacattgtcattgcataaacgatgatatacatgtttgatgagatcgatgtaattaaaccgaatgcactggtaatctgtggtatcgaattaatcactggtgatattaacactaagatagctgtgaatataattgctttagcaggaacgccatttgatgaaatttcacgaaaattgatcataaactttgaatctgactcttcagctaattggtagaagtgtcgtcctgcagaatagatagctgagtttaaggctgaagcagcagatgttagtacgacaaagttaattattgtagcagccgctttgaatccagccaattggaacaccataacgaagggacttgattcaggtgttttagcgataacatgccaattaatgatcgacataataataatcatggcacctaagtagaaaatcaaaatacggataataattgtattaatggcttttggcagaacctcacgtggattttccgtttcagctgttgtgataccgacgaattccataccttggaaggcgaaaaataccattggaaaggcagcgaagaacatcgaagcaccatttggaaatagtgaaaagtttgagaatacattactaaatgaagcgacagtatgaccaccacttgcgggcgccttaaatcctgtaaagattaatattagacccgttacaatcatcgctacaatagcaatgatcttaatcatggcaaaccagtattctgtttcaccaaatactctgacggcaattaagttaatcatagttaaaacaaacaaaaagagaatttgaattatccaagttttccaacttgggaaccaaaacttaacgtaagttgatacggctgttaattctgccatagctacgaaaagtagtccaatccaataggaccatccagcgaaatatcccgctccagcaccaacatacttactgataaaagaaacaaatgtatgttgggaagggtctgcataaagcatttcaccaattccccgcatcatcataaagaaaaatgcaccaagtactgcgtatacaatcaaaatagatggcccagttttagctatagagtttccggctcccaagaaaagtcctgtaccaatggtaccgccaatggcaatcatctgtacgtgcttctttttcaaaccacgtatggtaccatcggcattcatcgttgcgtttttttgttgactcataaatattatgcctcctcgattgataacaattctaacacagttatcattaaaccctcatttattagtgaacaaaaaatagggtaatctattgtgcattatgcctaatcaagtaacaaaaaagccaattgaatatcgaccaaaacatcgggcatgtcaaggttaacatctaataactcagatatttttttcaagcgataattaatggtattccggtgtacaaacatatcagaagcgacggctgttacattttgatgtaagaacatataggtttccaaagttttgagaagacttggattgtctaaaattgggcctagaattctttccacaaaagcatcgctctcttgcttgggtaacaagtttaacatttcttgggcactcttgggtctaaatcgcataatcggatgtgctactgatgtcagctgaagcgcatggttagcttgttcataaagatctgctaatgcacgaatgggttctgcgactcgagaaaagccgatggtaaagttatattctaactttgattgtgatgttagaaaatcgtatagttctttgagaaatgcgcgtgtatcaattttgttatcaactaacaaaatcagttgttgtttataggaaaataggagtacagaccagtttgattcgttaacaaaccagcgtgtcagtgcttgtaatatttcaaattgatgtgtttcaatgactgttttttttgctgtaaagtcaataaccgctacgcgatagggatttttagaatcaatatttgcgttctttagataattgtcaatcgcgtcatcacttagcccgtgttgcataatgttcaaaaagaagccagaacggttgcgaaactcagtttcatttaacaaatcggttctcgaatttgaaaatcccaatgcagtaattacttgttcgcgttttaaaagttcaaaatctgatagtgtcttattcgaactcataatagctgcaaaggctttattttcgtttagagcagaaaaaatgggagaaatctcgaaaattgtattattgaaggtaacgtgcaccttttgagttaaattcaaataatcaattccagattcttctcgtaaaaatttggtgaaaaagtcacgttgcggaagtaaatcagtactggcatataaggcacgaaaatgtgagtccaacaaggttagtggtgcttctaaaatttccgcgctaagatttaacagatgctgataagtattattagtttgcatcgttgacaactgatgattaatattaacaatttgatgcagttcacccgtatgagtgttcagaataatatcagtaatattttgaattgtttgtggcatcaattcatcagttggggtcatgaggattggtactcgacgtttgttggctaatataataatatcacgtggcaactgtgataaatgccggttcgtcttaatgcccaagccagcagcattatgatgatctagcgcgataattaagtctcgcagtaatgtccaatcttctttgaacaaaaagccggtagtgagcagtaattgaccaggagcaatatattcatcaaaatctggtgcatcaatcatacccacttggttgatctcgcgattgagcccttcggcgcctgctaaaattgggtattctgctaatacggggttagctaataattctttaacgttcataattgacctccaattgtgttgttactattatgccatgtttgcttattgtgtacaaataaaattaaaaaagttgtgcaatatgacgatgattattttttatgcgttcgttacagtaaagaaaacattatgaggtgagcgtatgcaacgtacagaaaagaaaattgtcagtaatattttaaagggatccttaggtaatttaattgagtggttcgattggtatgtttatgcctcgttctctatctattttgccccatcatttttccccagccatgacaaaacggccgcattattaagtacggcaggagtcttcgcaattggctttttgatgagacctctaggaagtctagtgttaggtaaatatgcggatcaacatggtcgacgggccgcattaaccttatcagtattgattatggccgcaggatcgcttgtaattgcgataacacctagttatcatgtaataggaattgctgcaccaatcatcttggtgttggcaaggctattccaaggattatcgttgggtggagaatatggtacttcagcaacttacctttctgaaatggccagccgcgggcatcgtggcttttatgcttcatttcaatatgtaacattaatcagtggacagctcattgccttgggtgttcaaattattttacaatcagtattatcagaagagatgttgactgactggggttggcgtattccatttgttattggttctctgggagccattgtagtattgttccttcgtttgagcatggaagaatctgaccaatttaaggcacaaaagaaaaacaataatggtagtctacgacttttgttaaagtatccaaaatctgtcatgacggtagttggattaacactcggtgggacaatcgctttctacacttatacaacttatttacaaaaatttatgattaattctgttgggttaccaacacaagaagtcacactgatcaactttgcagcattatttatttttatgattttacaacctatcgccggtgcattatcggataaaataggtcgtaaaccattattgttttggttcggtattatggggacaatatttacaattcctatttttctcactttgcaacaagtgaagacggggatgggggctttcttactcatgctggctggattaattattgttacaggttatacgtcaattaatgcaattgttaaagctgaaatgttcccaactgaaattcgtgcattaggtgttggattgccttatggcttgacggtcgccgtttttggtggcacggttgaatacgttgccttgtacctgaaaaaaataaatcacgaaaatttgtttttcgtctatgttactgtggttgtgttcattagtttgctagtttattggcgcatgacggatacaaagcacacatctaagcttgatcactaattatgttggaaattgctataaaatgcatgattacagtgtttatagtattgacgattacgtgaaagtctgtcataatagataagtatttactgcatgtcgtttaacgaaataaaatgcgagaaaggagggttatcacatggcaaaggtcatcgtacgtaagaacgaatctttggatgatgcattgcgtcgcttcaagcgtggtgtttcaaaagacggtactctccaagaataccgtaagcgcgaatactatgttaagccttcagttgctcgtaaattgaagtctgaagcagcacaaaagcgtaacaagaagaagggtcgttaattcgattctaaaacgtcacttaggtggcgtttttcttttatggtagaataacaatagattaaattttgaaaggttgatatacatgagtttattagaagagttaaataatgatataaagcaggccatgaaagacaaaaacaaagatgttttgtcagtgattcgcatggttaaatcaacggttatgaacgagcagattaatttaggccatgatttaacaaaggaagaagaattaacagtcctctcacgtgaagttaaacaacgtcaagattcgttgacagagtttgagaaaggcaatcgagaagatttagctgctggtattcgcgcagagctagctattttagcaaagtatttgccagaacctttgagtgacgaaaaggttatcgaattggtgaaggacgcaatccaaaagacgggcgctacatctccaaaagatatgggcaaagtgatggctattgtcacgcctcaagtcaaaggaaaaactgacggtaaatttgttgctaatcaagtgaaaaatctgttaaaaggttaattgaccgttatagattatgtaaaccacacatggtaaactataagtattataaaaagtgcgtgatgttgcgtacgttaaggaaaccgctatgaatccaaaagttggaacaataattaaagcaaacgttactgatgaaaatgagaaatatttctttgcacaagtcgatggctttacatatgaaattgataagtcagaacttgagaagcctctcaaaatcggtggatttgtgactggctttgcatatgaaaatgaaggacacaaattacaaattaccaagaaaacgcctgctgtacagaaatcagtatacggttggggaacagtcgtagcgaatcgacatgatttgggcgtctttgtttcaattggtttgccgaataaggatatcgttgtttctcttgatgatctaccaacgatttcaacactttggccacaaaaaggcgacaaattgatgattgccattaaagaagatcataaaggccgtttgtggggtgaaatagcacaacagcatattattaatgctgtatcgcgtcgcgcaccggaaagtatgaagtcgaccacagttaaagccacagtttatcgtaacaaaatggcaggtactttggttattactgatgaatattatcttggttttattcatccttcgcaacgtgacgatgagccacgtttaggacaagttgtagatgcacgtgttatcggcgtccgtgatgatggcacattaaatctatcactgaaacctttggcctataagaccatggatgaggatgcacaattcttattgttgcaattgcaacgacgggcggatcatttcttaccattcaatgataaaagtaacccagaggcaatcaagcgtcaatttggatttagtaagagtcagttcaaacgagccttgggtcatttatacaaggatagactaattgaacaaattgacgatggtataaaattagttgagaaatgatgcaagaaattgacaatgcgatagtggattatctacactatattcgaattgaacgtggcttatctgaaaatacaattaagagttaccaccaagatttggtacaatttggtgagtatctaaatagtgagaaactggtgcttgatcaagttgatcatattgttatcttgtcgtggttgaatcaactcagagatctaggaaaatccaatagttcagtgattagaatggttacgacattgcgtaacttttttggctatttagtgcgagaaaaagtcgtcgctcataatccaatgaatgatgttcgcccacccaaaaaagcagagcacctaccagcagttttgagcatagaggaaattgaccgtttattacaagcaccgatagaagatacaccacttggtcttcgaaatagaacattgctagaagtgatgtacgcaactggtttgcgtgtcagtgaattggttaatttaaaaatgagtgaccttcatttgcaattgggactgattcaaacacttggaaaaggtgacaaagaacgtattattccaattggtgaaattgcgattgattggctgactcgatattttaatgaaagccgtatcgttttacttaaagacaaagagtctccttatgttttcttaaatgatcgtggaaatcaaatttcacgacagggaatatggaagattataaaaaagttggtaacaaccgctggaataactaaagatgtttctccccatacacttcgtcattcttttgctacccatattttagagaacggtgctgatttgcgtatagttcaagaattattggggcatgcggacatttcgacaacacaaatttatacccatatttcgaaaaaaagacttagtgaagtgtatgatgaataccaccccagagcgtaaaaattatgttgacacaatcaagacaatcagatgaaaaaacaattatgggtattttatcgttgctgccagggctacgtgaaatatctcatttaaatgcggaaatagcatggtatcatgataatgaagcaagatctttatatgtttggcaaaaagagtctcaaggacaagtacttggtgttctaggtgttgagatttataataataatattgctataattcgtcatgttgccttaaccccagagtcacgcagtgtcagaaactacttcgacatgatttctgattatcaagagcaacattctgaagccttcttaatgggtaccttggataatcaaaagttaattaacaaatggagaaaagcaacatcgcgaaaaacggtctaacaattaaattaagtgattttgaagggccaatcgatctgttattacacttaattaagaaatccgagatgaatatttttgatttgaaaattgctgacattacatctcagtatttagattttattcatgcacaacaggctatgcagcttgatgtagcaagtgaatatttagtgatggctgctactttagttaagataaagtccgctgatttgttaccagaagaagagccagatgattatgccgtagatgaagagtatgcggatccacgtgaagagctgatgctacaattattgacctacaaacaatttcaagtggcaagcgaatctttgcgtgaacgtgaacaattaaaacaacaatcctttccacgtactcaaatgaaggctcctgataatttgaaacatcccataactttagctcctggtttatcgttaggggatttacaaacagcatttgctcaactattgcggcgaaaaaagcaggaaaaacccatcagaaggcatgttactgcggaaacatattctcttgaggaagctgttaacaacatcaataaacatttcttacagcatcaaacgggggatatgattccatttgcttctttttttgatgatatttacgagcgggagcatttggtagtcacctttttggcgttattagaaatggccaaagataaaagattaaaattacaccaagagcaccaacaacaagaaatttatgtagaaattgaggcgtttggcgaagatgaataatttaagtcaaatagaagcactattgtttgtatctggcgatgaaggcatttccgtgaaaaatatgagcattatcactggatttgatcgttcagcaatacaaggattgcttgaagaacttgtgttaaagtatgatactgatttaagtagtgcattacaaattcgtgaaagtgacgatgtgtatcgcctagtgactaaaccggaacttggtggcacagtaaaacagtattttgattcacctgtaaatgcaacattatcgcaagcacaactcgaaacactagttattgtcgcttataagcaaccaattacacgtgttgaaattgatacaattcgtggtgtgcaatcctcaggaactttacagaagctagcattacggcaactagtccacgaagttggcagaaaagacgaaccaggacgtcccatcatgtttggtaccaccgatgaatttttggactattttggtttgaaaagtattgaagaattacctccgttacctgattttaatatgttagatttaagtgatgatattgatggcgaactatttacgagtgcatttgatgtacatcaatcagaaagtgaaaaagaaaatgtctgaagaagcacagagactgcaaaaaattattgcccaagcgggtctagcgtcccgacggggcgcagaagaattgatcatcaatgggcgtgtccaagttaatgggcaaactgttaccgaattaggtacgaaagttactgcaaatgataaagtacaggtcgacggtgcgccaattgaaggacgtgagaagttagtttattacctgttaaataagcctcgtggggttgtgacaaccaatgatgatgaaaaaggtcgtcgtacggtattggatattttagaggatgtggatcaacgtgtttatccagttggccgtctagattatgatacaactggtgttttgttattaacaaatgatggtgtagtggctaatcaattaatgcatcctaaaactaaagtcgataagacttatgttgcaaaggttgaaggcattgcaaccgaagaaaagctagctcctttgaaacgtggagtggtcctaaaaggacgtaaaactgcgccagctcgtgtttccattgaaagaattgaaccgacaaaaagaacaagtatggtccgtctaactattcatgaaggccgtaatcatcaggtcaaaaacatgctcgcgaaggttggcctaccagtgcaaaagcttaagcgtgagcagtatgccttttttgatgtcactggtctacagccgggcgagtatcgtaaattaacaagcgtagagatcaaacgcttaaaggcacaagattacaaattgttgcgtcgtaagtaacaccgtgatacaataaaatcaaatttaataataacttcagggtcgggtgtaagtcccaaccggcggtgagacatgaattttcatggtaagcccgcgacctgcttttgcagctgatctggtcaaaatccagagccgaccgtaaagtcgggtataaagaagtctaaaaaagaaagtgaaagctgcattttttgttgtaccctgacaaaatctgtggttttttgtttgcatctactggtgaggtgagcaaacaagaggaaagaaatatgtcaattgttcctgtaacgcgagtgcaacgtactacattaattgcaatactaagcgctatttcatttggtttgatgctgtttccccaagtgccaatcattcctagtgctgattttttaaagctagatttttcaatcgtaccagttgtcattggcttatattggttaaattattctgcttcactgtggatcattttaattcgtaccttgctaaagttaattttggcaaatgagggggttaacacttatttaggattgccggttaatttattggttgttttggcctttatcacagttttaaaaattacaatgcccaaccttgagcagtatagtaattggaaaaaaaaaatcataccattaataagcagcacgtttgtcatgacaattgttgcgattgtcatcaattggtttgtagctatacctttgtatgcgaggtttgctaatttcgacattgctaaattcattggtttaaaaaactattttatcggtatggtattaccgttcaatcttatcgagggtattatatggtttgtcgtgagtatgatcatattaagggcaatacagccgctccagagaaggtttcattcttaacaaaacattatgagcaaagtcggtgttggtgtggtaaaattttatgtgaaccaataaaatggaggtcgtttctatgaacgattttgacccaaacaacatgagccgctcaaagcggcccaaaaaagataagctcgaaccaaaattttcccgaaagtcagattcaaaatccccaaataaaggatttcgtgttctgcttgttgtattagcgcttgcagttatatcttttgtacctgtgtatggcatgattgctaatcaaaaatcatcaaagccacaaacggctgtttcttcaagtacaaagcgttcatcaactactaaatctacgtcttctgagtcttctgaatcatcatcttccgagtcaagtgcatcaagttcttctgaagaagaatcagtaagtagcagtgaagctgcttcaagtgaggaatctgctagttcatcttctactgagacggctgaatcaagttcagcatcaagtagttccacaaccactactgcagttttgggtgctagtcaaacgttgtataattttgcagttacacacgggatgacaactagccaagttattgcattaaatccagggttaacagttgataattacacacagtatgctggtactgcactaaacattcagtaagaggactttttattattatgacgaattttcaagttgccattgatggcccagcttctgccggtaagtctactattgccaaaattttagcaacaaagctaaattatgtgtatgttgacacaggtgcaatgtacagaacaataactttagctgcaaaaaagaacggcattgcttataatgatgaagaaaaaataaaaaacttattgtcacaaacggaaatacgctttgaacctagtacaccagttcaacgtgtatttttgaatgataccgatgtcacggaggaaattcgttccgctgaagtgacaaacaatgtgtctgtagtggcttcctttgcggatgtacgttctaatttagtcaatcgtcaacgtgaaatagctaataacaacagtgtgattatggacggccgcgatatcggcacaactgtgttaccagaagcagatgtcaaaatttttcttgtagcaagtgttgatgaacgtgcccaacgacgttataaagaaaatgttgctaaagggatgactactgatctcgaaacattgaagcgcgaaattgaagcgcgagattacaaagattctcatcgtcaaattagtccattaacacaagcgaaggacgctattttagtggatacaacgggacaaagtattgacgatgttgtggctaaaatagccaacattatcgaaaatactattagtttctaatttacacggttaaaccgtgttttttactatacaagaactaaaatatttggtacactatattcatagtgtaaattgtaggaggacgtttgacgtcatgagtgaaacaaacaacgagcttttagcagctctcgagagtgcagatcaaattaaggtaggagatgtcgttacgggcgaagtactagccgttgataacgataaccaagcagttattggtttgcataccggtgaagaaggagttgtgccagcgcgtgagtactcagacgatcgtaacattaatctggcagacgaattgaaggttggtgacagtgttgaagctgttgtcatctctaatgtaacaagcgacaaggaaggcgtatcttacttgttgtcaaagaagcgcttggaagcacgtaaggcatgggaaaacttgtcatttggtgaaggtgatacagttgatgctaaagttatcaatgctgtacgtggtggtttagttgtcgatgttaatggtgttcgtggctttgtacccgcatcaatggttgctgatcgtttcgtgtcagatttgaaccagtttaagaataaagatattaaagcacaagttattgaaattgatgctgccaaggcacgcttaatcttgtcacgtaaggcagttgcagcacaagaacgtgcagcacaattagcagaagcatttgaaaagctatcagttggtgaagttgttgaaggtaaagttgctcgtttgactgacttcggagcattcgttgacttaggtggcgttgatggtttggtacacgtttcagaaatttctcatgatcgtgttaagaaccctgctgatgttttgacaaagggtgaaacagttaacgttaaaattttagccttagatgctgaaaagggacgtatctcattgtcaatcaaggctacacaacctggaccttgggataaggttgctgaagaagctcctgccggaacagttcttgaaggaactgttaagcgtgtaaaagacttcggagcattcgttgaaattttccctggtatcgaaggattagttcacgtatcacaaatttcacacaagcgtatcgaaaacccttcagaagttttgaagtcaggcgataaagttcaagttcaagttttggatgttaagcctgccgaagaacgtatttcattgtcaatgaaggcattggaagaaaagccagaacgtgaagatcgtggaaattcaaaggatagttcagcatcacgtgcagatattgctgcttataagcaacaagatgattcagctgcaacattgggcgacctctttgatggtaagttctaagaattctattgaaaagaactggttcgccagttctttttttatgataaatttatttatacaaaggaggtgccaaaatgtcagcaccaatagtagcaattgtcggtcgaccaaacgttggtaaatcaactattttcaaccgtatggcgggagaaagaattgcgatcgttgaagacatgcccggtgtcacgcgagatcgcttgtatgcaccagctgaatggttaaattatgaatttcgaatgattgataccggtggtatcgaaatcggtgatgcaccgtttttagcggaaatacgtggacaggtagaattagcaattaatgaagctgatgttattgtgatggttgtttccggccgagaaggattaactgaggctgatgaagtagttgcacgtatgctatataaatctgataagcctgtcgttctggctgtcaacaaagtagataatcctgaaatgcgccatgatgtctatgatttttatgcactaggtcttggggatccattcccagtttcaggatcacacggtttgggattaggtgatttacttgatgaaattgtaaaacattttcctgatgaagctgccgaacaagaagacgatgcgattcgttttagtataattggccgcccaaatgttggtaaatcatcaattgtcaacgctatgcttggtgaaaaacgtgtgatcgtctctgatattgaagggactactcgtgatgctattgatacacgatttgtgactgaagaaggggacgaatttgtgatggttgatacagccggtatgcgtaagcgcgggaaaatctatgagaatactgaaaagtactccgtgatgcgtgctatgaaagctattgatgatagcaacgttattttgatggttattgatgcggaagcaggaattagagaacaagataaacacgtggctgggtttgctcatgaagctgggcgagcaatgatcattgttgtcaataaatgggatgcgattgaaaagaatgatcggacgatgtctgactttgagaatttaattcgcgaagaatttaaattcttagattatgcaccaattgtgtttgtttctgctaagacagggcaacgtttagatagattgccacaaatggttaaagatgttgacgataatcatcgtaagcgtataacatcttcaacattaaacgatgtcattatggatgctattgcaataaatccaacaccttcagataatggtcgtcgtttacgagtatattatgcgacacaagtcgcaacgcaaccaccaacatttgtcatatttgttaatgatgttgaacttatgcatttttcatatgaacgattcttagaaaataaaattcgagaatcatttgactttactggtacgccaatcaaactcattgttcgcgcacgaaagtaaacgttgcaaaaatatgtttttaatgtaacacaaatgttacgaaatcccgaaaacccttgataacactacacatttggcgtttcttatgttattctagttacatgaaataatgtttcgacagatttcacggagcgcatcatgcgttaaaaaaactcttattaggagacaagaaaatggctaacaagcaagaattagtagattcagttgctaaggcaacaggtttgacaaagaaggatgctactgcatcagttgacgcagtttttgcatcaatcgaagaagcattgaagaacggtgaaaaggttcaattgatcggctttggtaactttgaagttcgtgatcgtgctgctcgtaagggccgtaacccacaaactggtgaagaaattcaaattgctgcctcaaaggtacctgcatttaagccaggtaaagctttgaaggatgccgttaagtaattaatagccatttataccgctgttttacagcgtttctggggaaagtttgggaaagcaacttattgattcctaatattatccagtatattaagagcaagctcaacatgggcttgctctttttctttttctttttagtatggtgttttaaataatcattaagggaactgactagatacaatctaaaattatgactagactaaatcaaaatattgagaagacgtatgaaaaaaggtcggcaaagcggtcagtcaatttaaaaatgaattccatgtcattatggaattcattagattgagtatgagtattactagtgtggtatttaaagagatttatgcgaacgaacactgacaacagcgtttacctcaggataaatatccgtgtgaacgaggtttaattcttctgcgagtgcattcgcagtattagcaacatcaatttgattgaattgcgataaacagaatcctgtttcgcccttttccactttttcctttatcatatcggcaacttgtttattaaaagccatatgaacccccttataaattttacttaactctaaatgagctagtaacttaagaataccactttacaaacgcttaaacaaaaatatacggcttaatcctcaaaattataaaagtaatcattaaaaaaatgacgcagtagtactgcattaattgatctcgataaaaagcgactagactaggcgtgcaggattacccacagcagtagaataggcgggcacatcgtttaaaaccacagcattagcaccaactttactatttgcaccaatagtaatattgcccaatatttgcgcatgagcaccaatgaagctgtagctctcgatatgagggtgtctacgttctgtcaccgtatgacgagcacccagagtgacaccatgtaatatggttacaccatcatcaataattgcagtttcaccaataacaacacctacgccgtgatcaataaatacgccacgaccaatttgtgcaccgggggcaataaatatatcagttcgtttggctgaccaacgagcaatgatggcagcgagcaaataacggtgatgaatatgaagccaatgagcaacgcgatgaacccacagtgcatgtaacccagggtaagttaaaatcaccatcataaggctttttgcggctggatcacgctttagaattgatttagcagtaaaaaacattttttctccactattatttcaattgattaaaaccttgttctaggtcctcaattaaatcttcaatatcttcaacacccacagagagacggattagttcgtcttgaataccatgagatagccggatattacgaggaatggcgccgtgagtcattttagctgggatttcaattaggctttcaagtgcacctaaactctctgctaaggtaatgatttttaagttactaatgaattgttctggatccagtccagcctttagctcaaatgaaatcatggcaccaaaaccattcatctgttgcttggctaaagcgtggtcaggattatcaggatcaccagggaaatatattttaccaactttatcttgtgttttaaggtagtcaaatattgtttgcgcatttgactggtgagcacgcattcttaatccaagcgttttcatacctcgttgtaggagccaactttcctgaggggccaagattgcaccaatcgcattttgtaagaacttaattttctcactaagttcctcacctttagtaacaactaagccggcaatgaggtcgctatgaccacctaagtactttgaagcgctgtgaacaacaatgtccacacctaaatcaattggcttttgtacatagggagaagcaaatgtgttgtcaacaatacttaataaattatgacgatgagcaagttcggaaattgccttgatatcactaatgcgtaatagaggattagttggtgtttcaaggtaaatggcgacagtattatcttgaatagcttcctgaatagcagataaatcacgggtatcgacaattgtaaatgtctgacctgttctttttaggacattgtcaattagcctaaatgtaccaccataaacatcgtttccaacaataatgtgatccccagatgaaaatagtgaaaaaatagtacttatcgccgcagatcctgatgcaaaagcaaagccagcagtaccattctctaagtctgcaattaagctttctacggcttcacgggttgggttgccagatcttgaatattcatattttgcctcgccaattttagtttgcttaaaggttgaagccatatgaatagggacagatacggcgccagttgattggtcaacactaatgccaccatgaataagttgtgtatcaaatttcatttttctttcctcagtttccataaatgtttgtgctcatgtaacgttcgctgctgtctgggaatatcgtgacaatattactttgtggcggcaaagtttctgccatctgtaggctagcagccaaggccgcgccacttgaactaccgataaaaagtcctaggttctcggcagcatatcgaacttgctgaaaggcattgtcatcgctaatagttaatgttttgtcaatgtgaattgattcgaagaatggtggtacaaattcaacaccaataccttctgtacggtgagcatgtgctgggccaccatttaaaatagatccttcgggttctacaacaatattttttatagttggatcatattcactgagatatttggcaattccagcaaaagttccaccactaccagcaccagcaacaaaagcatcaatcttttcgtttttcaaatctgtaacgatttctggtgccagcgttttgtaatatgtttcaggattcgcaggattcgcaaattgcattggcaagtagctgttttcaatgtcagctgctatcgattttgctttggaaatggcacctataatgccttcgttagaaggtgtgttgatgattgttacgcccaaggctttcatgagttgctgtttttcagcgctgaatttctcaggtacaacaagaatggttggtaatttatattgttgcgcagctaatgccaagccaataccagtatttccggcagtcggttcaataatcgttgaattttgattaattagatttcgctgccaagcatctgatagtaagaattgtcctaaacggtctttaatgctaccaccaggattgaacatctccagttttgcaaaaatgcgactttggtttggaacaggtatttgcagttcaattaacggtgtttggccaattaattgatgtatgtttttgattagcataatgtatccttgtatatttcttagtaaaaaaaaaacaaaaaacgcgaaaattcaattgaattctcgcgttttgatagtttaactgtgtaagtagaaaattttaagttatgatatacccaaaaaattcatgctcaataaacagtacaacatcgaaaacgcgttgtactgcagcatgttgaattaaatgtagcaaaaggtaacaccataatgaactcctagttatgaattgagttaaatatactatagataaaatattttgtcaaacaatgttggaagtgattttaatattgatagaattttaaattaatcttcttttaatttccagtctatatgataaacgtatgccaattaagggttgtcacaatgatgtgactttcaatgagtaatttaatctctgctggtaaaacactactgaataagtgaggaaaaaaatgaataaaaagtctcaggttgcacatgctgttatttcaaaacgctataaaatgtataaggctggtaaggtttggctatttgctggtttatctgcattagttattggtggtcttggtcagatcactgctagtgcggataccacatcgacaaaccctgtttatacgacagacacagcatcaacaacagatagtgcaagcgacacaacaagcagtgcgacagacgaatcaacaacaacagatagcacaagtgatacaacaagcagtgcgacagacggctcaacaacggctgatagcacaagtgacacaacaagcagtgcgacagacgaatcaacaacggctgatagcacaagtgacacaacaagcagtgcgacagacgaatcaacaacggctgatagcacaagtgacacaacaagcagtgcgacagacgaatcaacaacggctgataacacaagtgatacaacaagcagtacgacagacgactcaacaacggctgatagtacaagcgacacaacaagcagtgcgacagatacatcaacagctgataacacaggtgatataacaagtagtgtgactgacacaacaggtaatacgttaaatgcatctacgggaaacacgagtaatataacatttaattcatcctcagcgataattacaggagatggtgcaactagtgatggaaacacagtcacaattagcgaagctggaacttacaatattgagggtacagcgactgatgcacaaataattgttaacgcaccagtaactgcggcagtaaagttagtatttaacaatgttgatttagccaaccaaattggtgctgtgcttaatggtaagcaatttggtagtttgtcgattgaagtagtgggtacaaacaatatcacaacttctgtagtcgttgaagatgaagagtcattagatacaacaaatccgaatggcgccatatatgctaatggtgacttaacaattgatggtgatggtaccttaaatattagttcaactatgaatggtatatcctctgatggcaccttaactattaattctggtacgttaaatattactaagtcatatgaagctttggaaggggaaatcgtaacaattaacggtggaacgattaacctgaattcaagtgacgatattatcaatgctcagttagatcaaactaaatacgatgcaggatctactgatacacaagcaattaatattaacggtggcatcttaaccattcgaggaaatggtgatgggctagattccaacggtgacatcaatattagtggcggtacaatcatagatttaattaattcaacgcctgataatggtgcgcttgatgcagatggtacaattacatttacaggtggaacaattatttggggtggtaccggaacagaagggacgccagatacggaatcaacacaaagctatgtagctattggatccgtaacagctgggtcaacaattgttatttcaaaagatgggcaggaaattttctccacaactattcctgacgcgacaacgtatctaaatatatcaacggagggcattgtatccggtgaaacgtatcaagtaagcgttaacggtacctcgacggatatcattgctggtcaaggtggtggctcaggtatgaccgctgaaggtggtatgggcaacatggggacaccaccagatggacaatttggtcaaggaacttttccaggtagtggtagttttcctggtggagaagcacctgcaaataagccggatagtgcaccgtcagcaccatcaggagagagtatcccaagtccttctgaaaacaatgcccaagaatcaactaataacagtgcgccagcagataatgattcggccacatcgtcagcgcccaaaacagaagatggttcaacagtagttgcagaagacgctgttggcgaaacggacacaaactcatccaatacagttgagtcaccggacagcactgtaacagttacggctgatttagaaagcaacgatgctgaacaaacacttcaaacaagtaatgaccctgcagaaaatgtttcatcagtgacgactgctactaatgaaacatcaataacaaacgaaaatgatgacaaagccgagagtacaaaagttactacttcatcatcctcatccttaccaaaaacagggactagtaacgctagtgtgctatctagtttaattgcgatactggtacaagttggtttgttagcaggattaagaactaagtatagaacatcaaaagagactaaataattattattttcatgaatcgttagaaaaaccgtttattataaacggttttttgattagaacggttggttgaaaaatttagtgcaacatggaataataaacaggtaattattaaacattattttgtcatcatactaatggcagactaaaagggatgaaaaatatgcaaaaaataaaactaccaataactgataatattgctaccgaacaagttaatgaatttagaaagtttataacttctccagctattattcaattatctataggtgtcattgtcggtggtagtttgactgatttaatcaaaagtgtgattagttttgcttctaatttgttttattatttgtctttactactattttcaaaaaaccactcggccaaaatcaacttagtcttagacccattacgtagtgtttttgaaaactttctaacgttatgtactattgctgcatgtgtctttttctttgttaaattggtcaataaatttttaatcaaagaggcctcagagactttgggttataacgcacaacttgaagaaacgaaaaagttaattaagatacagcatgaaaccaatgagctactcaagaaatcagttaatctgcaagaaaaattattgaatcgaactgaagagaaaagggattaattcatgtcaagcagaggctttttggcctgcctgtaagcgtttgcaaaagaaatcaataagggttatactgaagttataggttaggtgagtttctaaagacggttagctgaccccaaaacaacttgttcgtagtttatgctattagtttacaagtattgccacgtgcatgatgttaaatgactagtttaagcaagatgatgtttatgttccccaaagtgagaatatagggcagttttcgtcaaaaagcaagttgttttttgttactcaaaacgatggtatgctaacagataatttatttgagtagcgtagcgtgcatgattatatcagagaggaagcacttatgattagtagaattgttgttgcgatagacggtagcgaagcagctcaaagagcagtcgattttagcgttgaattggcaaagaagtttgatgctaaaatagatatcgttaatgtaattcagtatccaaccatcacttattacgactctgaccaatctttttatgattctttggtgcagagaatgactaatacagcatcagcaaaacttgatgaggcagcagctgttgtcaaagacgctgaaattgcagttgatacacatgtcctacaaggtgatgctcgttttgttttggctgatcaggtcccagaacaactcagtcctgatttaatcgtaatgggaaaaaccggtactaatattgtcatgcgtgtattcatgggttcaacggctcgatatgtttcagagcatgctgaaaccagtgtattgctagtacaatagatttgataaagatgattacgctactttttggtagtgttttttttgtgcagtcatgattattattctaaatatattccagcagtaatctagtataatagtttttgtggaggaaacacactaaacatgacagaattaatacaacatgagccaacgcaagacgttattgcgcaaagtgttgcggctaaagtaacgaatataactaaaaagcaaattaatgctacactaaccttgcttaacgaaggatcaactgtccctttcatcgccagatatcgaaaagaaatgacgggtgaactggatgaagtacagattcgtgatatccaatctattgcaaaaaggtcaaaagagttagtagaacgaaaaaatacagttttgaaagccatttttgaacaacgcaaattgactgatgctttgcaaaagagtattcaagacgttcagacgcttcagggactagaagatatatatttaccatataaacaaaaacgtcggaccagagcgatggttgcacgagaaaatggtctgcaaccacttgccgactggttaatgacgcatattaatagtaatattgatgatgattttcgaaattacgttaatgaagctttaccaactatggtcgatgtgcgtgcaggagtgcatgaaattttggctgaacaaatcggtgaaaatgctaattatcgtcaatggctacgcttgagaatggctgtagatgggttgttggtttctagcttaaagcgtggtatggctggaaaagatgagcaaaaagtttacgagcaatattacgattttactgaaacaattaaatcacttcacaacaataaatttcgtattttagcagtgaacagaggtgaaaaagagggcatattatcagtgaaaattgatttttctgaggtgcgtatgatgcactttattcaaacgaaagagttgaacgggcaaaatccgacaggccaaggatatgagatattacaacatgccattgaagatgcttataaacgttttattcgtccagcagtcgaaagagaaattagacaagaattgacaagccaagcacaagagcaagccattaaggtatttggtgacaatctttatcatcttttgatgcaagcacctctgaagaataaaattgtgatgggttttgatccaggatttcgtacaggatcaaaattagcaattattgacagcaatggcaagtttttagctaagcaggttatctatccgcataaaccagctaatgtgcagaaacggtccgaagcaattaacactttcaaacaattggtatcagattacaaggtagagctggtagcaattgggaatggcacagcgtctcgtgaatctgaagagtttgttgcggaaaatttgccagccggtgtaaagtataccattgtcaacgaagcgggcgcttcagtctattctgcttccgagcaggcgcgggaagaatttcctgatttacacgtggaagagcgcagtgcgatttctattgggcgcaggattcaggacccgttagctgaattaatcaagattgatccaaagtccgttggtgttggtcaatatcagcatgatttgaatgcaaaaacactagatgaacaagtagataacgttgtcgaaacagcagttaaccaagttggggttaatttaaatacagcttcacctgcgttattagctcacattgcaggcctaaataagaatttggctcaaaatatcgttaattatcgaaacgactttggtgaatttacatcacgtacacaaatcaagaaagtaccacgtttaggtcctaaagcgtatgaacaggctgctggatttttacgtattgtggatggtaagaatatattagataacacggatattcatccagaaagttataccgctactaaaaagttattgtcattagcaaacataaacccagtaaacttagcgacagatgaagctaatacggtattgaaccgattagataatgagcacacagcggagcaattagatgttggtatacaaacgttgcatgatatgattatgagcttacaaaagccgggacgagatggtcgttcagaaatggtaggggcattgctaaaatctgatgttatgcacattgaagatttgaaagcaggtatgaaactacaaggtactgttcgcaatgttgtggattttggcgcatttgtggatctgggcgtcaaacacgatggacttgtgcatatttctagaataagtacacgtcgtattaaacatccatctgaaattgtatctgttggtgatattgttgaggtctggattgttgatgttgatgaaaaaagaaatcgcattggattaaccatgttggcgccgcaataacagacgttggttgtaataaaaaaaccttaccgcttagcgggtaaggtttttaattttcattaatcaactagaggtaagatattaacaatggcgatacgatcactttcatcgtttttcaagcgagtaataatttcgttataacgagcttcggacaatggttccttgcgatcaaatgataatattttgttttcaatgtgattactagtactaggatattgttcgatacggtagataataagtagctttttataagcaaacggttggacaatcataccatctaaacgattttcaactgtttctgtggcttgattagctgcattctcttcaatttgtgattttgcttttttaaatagtgacattatttcatctccgtgttttgtttaaagtaagtcgttagggccgtagttaagtttttggcaattttcttttgataactgcttttacgaatatatttcaagtcagcattgttattgatgaagccattttcaagtaagattgcaggttgactagtattttttattgctatataagcagctgtatcaacacctcgattattcaaaggcatattatttaacgaggaactaactacttctgctagcgttttagaatttttgtgataataatattgtgaaataccggttgctttggtaccctctgcggaagaatcaaagtgaaaggatatctgtgcatcggctttatttttttcgccaggaatggctattttcaaaagtggcacaattttatcactatctcttgtcatgatgacacgagcaccagtaggttttaaggctgccctcacatgcctggcagtacgtaaagtgtatgttttttctttatacttgccgtttgatgatagggcgccagtatcagaaccgccgtgaccagggtctaaaacaatagtggcttcactaatcggttttgctgttttcaagatggttgaatttgccacccaactggccacccagccgactttttcattgtcagaacggcggacttgccaccagccgtgtttcttgtctatcacaattagtcgtgtaccactttttagtgaagctaatgatttgtattgtcgcccagggccatttcgaaactgaacattgttgggatgggtaataatctcttcttttgaaacgagtgaaataattaatcctactactgtaattaatatactgacagtaatgatgatgccaatcaaattacttaaaagccattttttaaccataatatccttgcgcacattttctatttatatatagtagtttaccatatttttatttttgaaaacgcttacttaatttggaatatattatcgttattatcttaaatttactgtataatatagttttagaaaagaaaaggattaaaagagtagacgcagatgtcaaaaataatggcagtaaacgccggaagttcttcacttaagtttcaattgttagaaatgcccgaggaaacagttattacacaaggggtaatcgaacgaattggtatggacgatgcaatcatcacagttaagtatggtgcagatgttgaacctgttcgtttggttggtactgaagatggtacaatttcattaacaaaaagtggtgatcagaaatacgaagctgaattaccaattaaagatcatcatgcagcaattgatctgatgttaaaaaaattatcagatttaggaattattaaagattttcaagaaataacaggtgttggccatcgcgttgttgctggtggtgagtggttcaatcattcagttgttgttgatgatgacgtgttatctaagatagatcgcttagctgattacgcaccattgcacaacccagctaatgcaatggggattcgagcattccaaaaattgttgccacatgcgacttctgttgcagtgtttgatacatcatttcatcaaacaatgcctgaaaagaattatctatatagcttgccatatgaatactacgcacgctacggtgctcgtaaatatggtgcgcacggaacttcacatcgttatgtaactgaacgtgcggcagacaaattaggaataccattagatgagtttaatgcgatttcatttcatttaggtgctggagcatcagtaacggcaattaaaaatggtaagtcatacgatacgtcgatgggattcacaccgcttgctggcttgacaatggcgactcgttctggggatgtggatccatcattaatttattatattcaagaacgtgaaggcctttcaaatgaagaaatgcttaatgtcttaaataaaaaatctggtctattaggcatctcaactatttcaagtgatatgcgtgatttggaaaatgttcaggaaaccaatactcatgcgcaattggcattggatatgttctacgatcgtgtgattcgttatgcagggcaatattttgctgaactgggtcgtgtggatgctattatttttacagcaggtatcggtgaaaacgatgcagtaacacgtgctaaagtattgaaatcatttgcatttgcgggcgttgatctagatgaagaagcaaacaatgttcgtggtaaagaaacaattattacaacatccggttctaaagtaactgggttattgattccgacaaatgaggaattaatgattgcacgtgatgtggtaacattacaaaacacaaaataaaaaagttggcgtaagccaactttttttatttactcaattattttcaattgaccccggacttcatcaagagaattatagcctttttctgttaaaatagctgctaactctttttccaaacgttcaaaaacagatgttccttcgattgccaattgtgaaccaacttcaactaagtcagcgccacacaaaacgtgttcataaacatcacgtccagaagtaacaccaccagttccaaccattttaatacttgggtttaaccgctgacgtagtgctctaacattagctagcgctgttgctttgacaatgggaccaccgacaccaccaaaaccacctttcggtttaatcacaactgtgtcagtttcttcatcaatcacaaggccattaccaattgagttgatagcattgacaaaggctaatggaaatttatttaaaatgtttgcaatattgtcaaaatgcacaatatcaaagtagggtggtaacttaacgccaagaggcttggtgaaaaatgaaaatacttcagttaaaatttcttcagttgtttcaaaatcataagctgtttgaggcttgccgggcacattaggacaagatagatttaattcaacaagaccattgaattctgattcttctatcttgagcaacatatctaagttctcttgctttgataaaccagcaacagagaaaaagatcggcttgtctgtttgtttttgggtaacataatccatgtaatagtcaaagccttcatttggtaagcccattgaattgatcgtgcctaagccattggtcaattcatgatatcgaggtgagacgttacccgggcgaaggcttggagttgctgatttcgtaacaactgcgcctgtatagtctgatgctagaacactatctaattcgtcgctagtctggcacacaacacctgcagcgttgagtaaaatatggtcgaagttgaaaccagcgatgttagcagttaaattcatgaaaataatcctttctgttaccttaaaatggttatcttattatatctaaaacttattgagatataaacccccaataatggttataatagtattatgaaacaatttagagtagacaatttaaaaagtacatatggcgaaaaggttcttttcaatgatatttcatttttgattacggaaggtgatcgaattggtttaattggtgtaaacggcagtggaaaaacttctcttctgaatgccatttctggaaaaaagccagctgatgctggaacaatcacgaagcaaaatgactatacaatcggatatctggcgcaagacccttatttggatgaccactccttattgatggatgcaatcttgtctggtgatcaaccagtattccagacgatacgacagtatgaatatgctttgcgaaaatatggggagcaaccaacagatgaaaaagttgcccaaaattttgaaaaagcacaagatgctatggaccgagatgatgcttggacaacggaatctcaggtaaaaacaattctaacacagctacatatgccagagttgcataaaaaagtgagcgaactttcagggggacaacgaaaaagagttggattagcccaagttttaattcaagagccagatttattgatattggatgaacctaccaaccatttagattttgattctatttcttggttagaaaagtatttagctgcctataagggggcagttttagttgttactcatgatcgttattttttggatgctgtcacaacaagaatattcgaattatcatttggcgatttgtatgaataccaaggtaattaccaagattatatgagtggaaagtctcagcgtattgagcagggaaaggtcgctgaacacaagcaacagcaactatacaaacaagagctagcatggatgcgtaaatccgctcgtgcgcgaacaaccaaacaaaaaggtagggagaatgcttttgctgagttagaagctaatatgggtaccttgcagctcgatgaagatgtggctgttaatcttggacagcaacgtttaggtaaaaaagtaattgttattgaagatgcgactattcaattcgacaataaaaaaatctttgaaaatttcaatttacgagtttcctctggtgatcgtattggtatcacaggtgctaatggcgcgggaaagtctacttttttgaacgcaatagctgggagagtgccattaactagcggaatcattgaattaggtgaaactgtaaagatggcttattatacacaggttactgaagagattccagatgataagcgtgtgattgcttatttgtcagatgttgcaactactgtaaaggacaaagatggcaatcaaattagtgtctcggacttattagagcaatttctatttccaccatttatgcatggaacattaattcgacagttgtctggtggtgaaaaaaggcggctgtacttattgaaactgctattacaacaacctaatgtgcttttgcttgatgagccaactaatgatcttgatattggaacattaactgttctagaagatttcctgtctggttttgctggggccgtgattactgtttcccatgatcgctattttttggataaagttgctaatcaactatatatgtttgaaggggatggtgttatcaaacgctttgatggcctgttcagtgactatctggcgatggacttagcaaaatcagcaccagcacaaaaagaagaaaaagtagttgctgataagaagccgcaaaaaaagaagttgacatacaatgagaaaaaagagtggcaaacaattgaagatgatatagcttcaattgaacaaagaatctccgaaattcctgaagagatggctcaaaatggtacaaattatgtcttgctaggcgacttacaaaaagagttagattcgctaaatgaggacttggaagaaaaaatgaatcgttgggaatatttgagtgaaattgtggaaggcttgtgataaatcataagctttttatttttggtcttcgtattatttcaagaggaaaataatatgattttaaaacagtttttattaggtttacatttaacttcaggcattggtcatgctggagaaaaaagggtcattgatgtaattgctaatcatctgataccagagaattatccttggaatattgaaactttactggcagtagtcagaccattaccgcaacatattgctaaaataaaagctacatatgtagcagcttgtcagaaggcagaaacaagtcaggaaaattattttacttattttgatgactgctatccgatacagctcaaagaaatatttgacccgccattaattctgttttatgaaggtaacttaaacgcactggaattacctaatttagcggtagtgggcacaagaactgctacgccctatggattagaatgcttacgatcactattgccaaatgtaataaataggggaacagccattgtttcagggctggctaaaggtatcgatgtaatggctcaccaagttaccttcgccaatcagggcgtgcctatagcagttataggtacaggattgaatattgcttatcctgcaaagaataaagtattacaacgacaagttgcacaacatggtattgtcttaagtgaatatgcacacgatgttgggccgcataagtctcattttccagcaaggaaccgtatcatagctggtctatcatcggctacattggttattgaagctaaaataaagtctggtagtttaataactgctaactatgcgctacaaaataacagagaagtgttgtctgtacctgggtctattttctctgaaaattctcagggaactaatgagttattacaattaggtgcaaaattaattagtcgttcagaggaagtcattgaaagtgtgcgaacctttagctgatcaaattaggtttttgccgaacaaacaaaaaacaagacaattacttatcttgtttctttgcttgtgaaagtaaggctgacttaatagcagcgactttttcggctttagtagcttgcgtttgttgactagacttgtacttagcattagcttgtttctgtttaaagtcaatttgatatcgtcccatgtttttaaactccttttgaagttctcattataccataggttcagattccaaaaagcatgaattggttaaaacaatcaaaagtatcgatcaaaccagtgtattttaatcctcactgtgtgcagctaaaaatttttgaatggcaactaaagctaaatcatatcttccagcttgacaatgctgttcaccaccagtttctttagtgaaaattttagtttcaagtgattttgcgttcgttaattcttgttgttctagtaccaagtcattaaaaggtacatattgatcatcctttccggcgagtaacaatacattttgattcactaaatgtccaattcctttcactgtatgcctttcaatttcttttagcagtgagtaaggggtgtcagtaccagtattttcatagccttttgtaaagagaaagtttaagttggcatcagaatgaatcaaagtagggattaattgatttgttttttcaacgtcgttattttgtagtaattgacgaatatgatttcgtgtgtcttttgaaaaatctttcaaaaaagtatttaatccgtcataaaagaaatcataacaaacaacgttcttgattcgcttttcgtaggcagcagcacgaataacgaaataaccgccccatgaaacacccatcgcatcaacttcgtctaaattaaaataatcaatgattgcactgacaggattttcaaaatatggtgtgaacttgatgttattatcaattaaggctcgtccttgaccgggaccgtcaaataaaatcacattataatcggttcccttaaagaaattgaccgcaactaatatttcttccataaaactatcaaaaccgttgatgataatcaaagttttagtggctgtgggatttatattgacctttatggcaggcaaaaatgttttttgatagggtacttgataactttcataatcaatttcagtatgtgcacggtaaaaattatttaagtatcggtgaacaactgtctgcttattttcgtcatcttggtttaagtaaaactgggcaaggccaaaataagcgcaagcgagagcatgatcttcttctttttcgcgtaattcaccgaatgagaaccaagttttgtaccaagaagcgtcatttgttagtttaggtatgattatttttaaatcatctttcacttttgaactttctttgattccttcaagttgacgatttatttgcaaattccattgtggattatttttgatatattcataaaacatattagtacctctttctttatttgttaaactcattataattaataaaataaggtcaaacaattatcagttgatgttagtaatgtccataaatggacgatatgatttgacctgtctagttatggacagaaaaggattattttgtatggcggatattagaaaaataaagacgaagaaaaacattgagatggcctttgttaccttgctgaatgaacgaaatttcaaatcaataactgtggaagaaatttgtaagcaagctatgacaagccgatcaacattttatctgcactatttagataaatatgacctcttaaatcagcttgtcgaaacacagttttcagtatttgaaaaaattgtggataaaaggattgaggggttgatttctgggcaatttgaagaaacgattacacatttctacaatgaattagtcaacaacaaacagattattcgagctttatttacaatcaatgaaccggaatttaatttaaaacaaaaatttgaggatacattatatcagcattggctgaggtatctcagtgaaaaatcatctttgaagtataacgaattgattgcaaaatttggcgctagtattgtctttgacacgcttaactggacctttgaaaatggcattgatgatgaaacgctgttatttgtggaaaacatcagaaagaaaatacttgagatgtctacatctttaaaggaaatacatgacgaaccatagcaaagagctatggttttttagttatgagagacttcatataatattgttatttattattgtattttatcgatagtaagagtagaataagatttaggttatgcaagcgcttacataatacctgacaaagggtttcatagtaacaaatgaaacaacattccgtttatgaaagataggagaaaagaatgaactatcttattttggttagccacggccagttctcagaggggctcaaggacgctctgggaatgtttgttggtgatggtattaaaactgtgaaagcaatagggctccaatcaggtgaagatacagatcattttgaaaatcgtttcaaatctttattatcaacacttgaacaaaattcagaattgcttattctaggggacatcatcggcggtagtccactgactaccgttgtaaacgtattgaatcaagaaaataggttagaaagtacaattgttcttggtgggatgaatttcccaatggcactcaatgctgctattttgaaagacagttccagtaaaaacgaactaattagcaatgtattacgtgaaggagcctctgcgttgaaacaatttgagattaatgatgatccagaggacgatgatgagatttgaaaggacgaagtaattatgagtatttcatttgtacgtattgatgatagaattattcacggacagaccgtgacccgttgggctaaagaatatccttgtgatggcttgatagcagttaatgatgcagcagccacaaatcctattctaaaggatgcattcaaaagtgcctcagaaaagaaaacgtttgtttggacactagaccactttaaagaaaaagctcaacaagttttggattctgatcgacaatattttctaattacgaaaacaccacaggatatgaagaaaattttggttgattttgggttcaagcctgatgatgtaaaaacggtgattgttggtccagccaatgatcggcctgacgcagtgaaattaggaaataatcagtctattacgtctgaggaagctagagcatttgatgatattcaagcgaaagggtaccaagttaagtttcaattgttgccagatgtatcaattggctattgggatgcttttagaggaaaatttaatctgtagtctaacataaaaagaggttagaaatatgacaattagttgggtacaagcaagtattttaggtatttttgcaagtttgtcttccatgccaggtatggcaggatccacaattggaaattatacactagggcgtccgttagtgggtggcttagtctgtggattggttttgggagatcttaaaacaggtattgctgctggtgtcgcgatgcagttagtctatatcgcgttggttactcctggaggcactgtttcggcggatcttcgagcggtctcctatatcggtataccattagcaatggttgctattcatgctcaaggattagtagcaacatcaggaaatgctgctgatttagctaaatcaatgggtacattagtcggaactgttggaacggtgttgttctacggaacagcaactatgaacttggtttggcaacacattggatggcgagcagttgaaaaagggcaatttaagaaattgtatgttgtggattggggactaccatggatttcacactttttcttctcatttattccaacactattcatgacacattttgggtctagtgctgttactgcattgaagacagcattaccaatggatggtattccaatgaaaaccttgttcacagttggtgccttactcccctgtgtaggtatcgcaattttgttgaagcaaatagtagatagcccacttgatttcattccgtttttcgtaggctttacatttgctgcttctctaggtttgaacttggtctcagtgacagtggtttcattaattttcgccatgatttcatacaagttagacatggcaattagcaccaatcgacaagttgcgtctccgggatcaaatactgatgtgaccgacgatgatgaggaagacgaggatatttaagatggataacttagaaaaaaagaaaatttctcgtaagactttaaacaagtcgtttcattactggttttatggccatcttacagcgttctctcaagaacacatgcagacatttggttatttgacttcaatgttgcctattgtggaagaattgtatgacaacaaggaagatcaagaaaaggcaatgaaaacctacacggcttttttcaatacagagccacagttaggtactgttatagtcggtgttacggctagtttggaagaggcaagagccaatcatggcaatgttgatgatacaacaatcaatgggttacgagccggtttaatggggccaattgcaggaattggggactcactagttgtcggcacattgatcccagttattcttggaattgctttggggatgtccgacggtggatcaccgcttggtgcaatattttatattattgtctggaacttacttggatacttcggtatgcgttttgcttacttcaaaggttatgaattaggagataaggcggtaggaattttagttggcgctcaaggaaaagcgattcgtaaagcgattgcaaccgtcggtggtatggttgtcggtggcgtcgctgccacttgggtgaccgtaaaaacgtcctttaaattaacaaactcatctggaaaagcgtacttagttttgcaagacaaattagactcggtgtatccaggattattgaccgctttgtttattgtattttgttggtggttaatggctaagaaaaacatttcacctattcgggttatgctcattttggtggttgttgctttgatcggcgtgttagttggatttttcaatcctggactaagttattaagacataaagaaggtatttattatggcaaagagcatacaaaatttggacaagggatatcaaagtgaaatctcttatcagcagaaaatgattaaaaatcttcaacattggcaatcctttttctcaatgattgttggtctaagcattcttcttacttatttctttgtccatcgaaatgtttggttatttggtacaggattagttttaggcacaatcaatattttaattgtttttatcattggttatgccatttatagaggacaacaaaatgttagtgtgattgttgaacgatatgatgaactagtcaaacctaaataaattttaaaggtttctctgtttagacagagaaacctttttagttaacataatacctatatcccttaaaatgaaaatagcttcaaacactggtatagaggtattcctacttcgaaactaggggttgacaagatttgtttaaactattataattaaaacagttgaatgatttcagtcgcaaaccaaatagtttgcgacttttattgtttgaaaggtggttccattggcaaatcgtattccgcaagcttttattgataatgtgcgatcaaaagtaaatatcgttgatgttatcggccaatatacacaattggtaaaaaaaggccgacaatggacgggctcatgcccttttcatgatgacaggcatccttccttatttgttgaagaaaacaagcaagtatttaattgcttttcatgtggtcgctctggttccgttttctcctttattatggaaaaggaaggatacagctatcctgaggcaatcttatcattagcggaaagcgttgatattccaattgactcaagtatttctgcgaataatggtaatcaaattgatggcacaacacaagcaatatatcagctacacactgatgcgcaacgattgtaccaacacacattgcttaacactgtttctggtgaacaggcactagcctatcttcatgataaaaggcaattaagtgatgagattattaaggaatttgggataggttttgttccggacgataaccttctattgagttatgcgaaggagaaaaatttatctcatgaaatattaatggcttccgagctatttatcacgaatactgtgagtggtgacatgcgtgatcgtttttcagggcgtatcgtttggccaataaaaactgaacggggtcaagttgttggcttttctggccgatcgctagacgctgaaaattcaatcaaatatatgaacagtccagaaagcccattttttactaaaggacgtattctatataatctagatcgagcgaaaaacgtcattagacaaacgggtacggcgatgatttttgaaggctttatggatgttatttcagcacacatggccgatgaaaaagttggcgttgcaaccatgggaaccgcgctaacacctgatcatgtccgacagctttcacgcattgcgaaaagaatacttcttgtttatgatagtgatgaagcggggcaaaatgctgcaaggcgttcaattgagctctttaaaaataatgctaaagatatagaggtcggtgttgtccatctgcctgacttgcttgatccggatgaagttcgaatacagcgcggattacaagttttaaaaaagtcactaaatcaaagcatcttaacaccaattgagtttttggtcaatgcagccagaaatggtaagaatctaagtaatcaagcgcagtatctaacgttcttgcatgaagtcatgcaaatcttatatacagctacgccagttgaacaagatattcagctgactcggattgcaaatgagtttggtacatcaaagcaagcattacaagcacaactacaacaaactaagcagtcagtaaaagtgcaaaatagtcatcaatcagtttcgcaatcatctcatgttgcgagtgactttagcccaaaggtccctgaatatgaatttggttttccagttgagcctaatcgatatcaaaaaatttcaaaggttgagttggcagagcgtgccttaatcatggcaatgattaaagatccgtatacgctggaacgtgttaaatcgacagcgggatttgcttttgttcatcctgagtatcaattgctaatgatgctgactgaaatttatcaacgagatcatttggggacatttgatattgctcaatttatggattttatacaaaagccaaatttgaatcaaaaaattatggccattgatcacagttttggcgatataaaggtcgaaaatgatgcggttcaagattatttgcgtataattatggaagaagcacctgtgtcaaatcgtgttcaggaattaaaacaactaattgaaattgctaagcaacagcatgatgatgccaaactagttcaactttcaaccgaattaattaacataaaaaaacgacaacattagtcgaatcgatgttaattaaatagcctcattgtaaaatataggagtaaaaatgacaattatttcaagttcaagtaaaatttcagatattaaagattatcttgatgagcaaaaaattgcttataatagtcgagcaaagaaggctgaactattagctttggcacaaggaaagactcctgaacaagcggcagcagctggaaaagcttcaaagccaaaatcagccaaaaagtctggtccactaaaaaatcctgagtacgacaaggcaaccaaagcgttaattgctgagtataaagcagcaaaacaaataacatatgcagcactttcaaagcgtttagctgagccctttaacttagatgaagaaaacatcgaacgtctgatggaaaaagttgaagatgccggtatagcaattgttgatgacaatggcgatccagcgccagaagtgttaaaggccaagcagaacaaacccactgatcaagagttagcagaagccgaggaaaccccagctggtattaaaattaacgatccagtgcgtatgtacctcaaagaaattggccgtgtcaatttgttgaagggaaatgaagaaattgatatcgctaagcgtattgaaaatggggacgtcgaagccaagcaagagttagcagaagccaacttgcggttggttgtctcgattgccaagcgttacgttggtcgtggtatgcaattcttggatttaatccaagaaggaaatatgggcttaatgaaagccgtagataagttcgattataccaaaggatttaagttctcaacgtatgctacatggtggattcgtcaggctattacacgtgctatcgccgatcaagcgcgtacgattcgtattccagtccacatggttgaaacgattaataagctgattcgtatacagcgtcaattgttacaagatttgggacgtgaacctcttccagaagaaatcggtgctgaaatggatttgacggccgacaaagtacgtgaaatcttaaaaattgctcaagaaccagtatctcttgaaacacctattggtgaagaagatgattctcatttgggtgatttcatcgaagataatgaggcagtttctccagctgattctgcagcatatgaaatgctcagggaacaattggaatctgttttggatacattgactgatcgagaagaaaatgtcttgcgtttgcgcttcggattagaagacggacgtacacgtacattggaagaagttggccgtgtatttggtgtaacacgtgaacgtattcgtcaaattgaagcgaaagcgttacgaaagttacgtcatccaagtcgttcaaaacaattgaaggatttcatggatgagagtacgaattaattgattgtgttctgagacttaataatagcggttcatcaaccatcccgcttaaaaaaactaggagatactatttatgcaaaaaacagtaagtgcgcgacaaagcaatcgcactagaaatatcacattaacagcgattgttgctgcgttgtatgcagcaattacgttagttatagcaccaatcggatttggaccagttcagttacgtttatctgagggcttaaatcacttatccgcatggaataaacgatatattttggcattggggctaggcgtttttatcgccaatctcatttcgccattaggttgggttgattggatatttggtaccgcaggtaccttgattatgaccactgtaacttatctgttgactcgcaaagtaacaagcacgctggtaaaaattttaattagctcttttgtagtttctacattaggaatgggtattttagcagcagagtttacatttgcctttaatattggtgccagtggttcatttccttcaggcgcatcaggcggtcttttttcacaatggttggcgtactatattagtgttttgccaggagaaattgtgtcattgattgttggtggtattttgatttttgcacttagtaagattattaaattagacaaatgattgaacaaaattatacaaataaaaatgttttattaaccggtgctgcttcaggcatcggtttttcgcaattgaaaacttatttgtctcaaggcgcaacagtgtatgctttagacaaagaaaaaattacgtacacacacaaacatttgcatacgtatcaaattgacattagacaacacaaaaaactagaaatgttggtggaacacataactagtgatgtttcaattgacattctattgaatacagcaggaatcttagatgattatcagccatctttaaccattgacttggagacttggcaacgggtgatggatacaaacttaacaccgatgtttattttatcgaatgctgtattaaccaagatgattgcctctggatatggacatattattaacatggcgtctatagctggctttactgctggtgggggcggggcggcatatacaaccagtaaacatgcaattattggatataccaaacagttggcttttgattatgcttcaaagggattacatattaatgctatcgcgccgggagcaattaaaacaccaatgaatgccaaagattttgctggcgatgctagtatggcccaacaagttgccaatcaaacccccgcaaagcgctgggctgcaccacaggaagtcgctgatttaacaatgtttttgacaagcccacaagctgactatattaatggcacagtagtaccaattgacggtggttggacattaggacattgaacaaaaaatatttttttcttccatataatatagtcaatccatgtcacaattaaataagggtagacaaattagatttaaagagtatttgtattataatatttatttactggcagatgaattttcgcatgagtgtgggttatcgctgatttgaagttttaaagtataatgattgcttcattcaaaagtggcctttttcgaatgattaatatacaatcactatacctgatataattatttagaacaattacgagtttataggtaaaaagccataacattttgttatggctttagtaatttttcgagactttttagtagttcttgcgcattatgactgagattgtgatcctgttggatcacatagccaaatgttaagtaggcatcttctccttcaatttttaaatttttgatatcatattgtttatggccaggagaaaccatattaatacctagctcaacgacatctgtttctaaaatgatatttgttaaaagatgctcgctattggtgtaaacagttggttgtagcgtatctgtagcgaagccaccaacattaacttgttccaattggtgttccatagaaaaaaaatcatttaatccgcggacaaattttaattttagtagttcttcaaacgagattgatgttttattgtaaagagggttgttatgtccgacataaatacacgcctctcttttttcaatctcaataaattttagtttcttgtgagaaataatatgtcgaaaagcctttaactggttttgagaaacgtatagaatgcctagctcagagaatccttgggaaacttgagtcgttatttcttcaacggtaccttgttggtgagaaagaatcatatctgggtttttctggtatagttcaactaacagccatgacatgatattactgggataggttgctacggaaaaattattattacttgatatagaatttgtatcagtaatcaaatttacgtttttcaaaatattttcagcataactataaattgatttgccatacgctgttagtttcaatcctttgctagttcgttcaaatagaggagagcctaactcttgttcaaaaagtttgatgaccctgctgacattgggttgggttgtaaacagtttagcggcagctttgctcaaactgccacagttatgggcagtaacaaaatattctaattgcttaatttccatacgcaccacactttcaaaaaaagttgttaatcgattatagcatttattcagtggaaccaagataagattatttaaacattgcgagtaaatagttttctaaaaacagtatacctaacttaggtatgctgttttttgttcctgaaaagagatgttatttgtgcaatttgtacaaattatatttttaaaaaggcaatttaactaatgaaataaaatagataagtatgtagagtagactgcaatatcaaatagcggatccgtaaatacgaactttgatacaaatcagtgcatttttatttttattttaagggaggtattgtcgtaatgacatacaaaaatgaacaaaacacaaacatattgtacaaagggaataaaattgaccccaatcgtgtcagtgatccagaagtgatgcctttatatttgtcaacagctcataatgtggcagatttagatgatctgcaaaatacttatgatcgaaaaggttatgcgtatacgaggtcccataatgcgaatcgtgatgggattgcagaacttatgacctacttggagcaatcagaaaaaagtgtcatcacgaacacaggtatgtctgctatatcaacaacactcttagcacttttgacatcaggtgatcacgttgtggctgataaaacgctgtatggtgaatcaattgatttgcttaagacactaagtaaatacggaattttagttgactttgttgacattacaaacctagatgaggttgcttcggttataaatgcgaacactcgaattctttatacagaaacagttagcaatcccatgatgacagttgcaaatattaaggcaattgcagatttagcgcatagccaccaaagttatcttattgttgacaacacctttatgacgccagttttatttcacgcactaactgatggtgcagatgttgtgattaatagtttaactaaatttgcaaatggccatggtgatgtaacattaggatcaattagcgctaaggctgagataatagaaaaaatttataaccttcaggtgctgctgggtacgacaggggatccttttgattcatggttagcaacacgtggtatcagaaccttagacttacgtgttaaaaaacaatcaagtaatgctttgtcattagcaacatttttggaaaaccatcagctaattagcaaggtttattacgctggtttaaagagccatccacaacatgacttagcggaagcgcaattttctaaccaatatgggggcatgttgagttttgaattaaaaggcgatcgtcaaacaattaataagtttttacaggagctaaacttgacgaagtatgccatgacccttggaggcatacgaacaacaatatcacatccagtctcttcatctcattatgatacgccagaagaagagaaagcaaagattggtattactgaccaactactgcgtgttagtgtcggtattgaggatgaagcagacttaattcatgactttgagtatgcattatctcagatagagttagaggaaggtgaataaacatggtagctccacgtcaaaaaaagtcacacaataatattgtgtatattgtcttaggtgtcgttattgtagggattgtcataggcacaacaaaattggtgggacattcagcaaccaccaaaagtaaatcagaaaagaaaatatcagtattaacgtatgctaactggaacccgtttgaatacataaaaaatggtaaggttgttgggtttgatttagatatcttgaaatctttgtctaaagaagcgggctatcagtatacgattaagaatactggttgggactcgatgtttacacaattaaattctggttcagctgatgcagctatttctggtattacaattacaaaagatcgtcaaaaaacatattcgttttcaaaaccttactttgtttctcgacaggcaatcattgttaagaaaactgacacagtaattaaaaatgcaactgatctgaagaataaaaaagttgctgttcagctaggttcaaccggagaggaagctgctgaatcaatccttggcaagaatagttcaaatattagcaaagacaaaggcggcacaacatttttacaggttgttcatgggcaagcagacgctgcaattggtgacgaaaccactgttaaaaagtatgtggcaagtaatccctcatacaaattaaaagttatttatgacgataaaaactttgaaccagaatattttggtttgatgtttactaaaaattcaaaataccgttcaacatataacgctgctttgaaaaaaataattgacaatggcgaatatacaaaaatttatgaaaagtggtttggtagtaagccatcacttgatgtcataaagtcacagcaatgaggagatgatcaatgagttttagttatgaaatgattttagattacgccccatttttcatgcatggtttactatacactttgctgttttccctttgtggggtagtttttggaacgatatttggactgattattgcacttggccgtatgtcgaaaaaccccgttatttctggaatatttaaaacctatattggtttgtttcgtggcacaccattgtttgtacaaattttgattaccaactttggtgtcgtaccggcaatttttggacattccaatccatatatagccggtgccctgtccttgtccctgaatgcagcggcctacattgctgaaacatttcgttcaggtattcaatccatttctgaagggcaacgtgaggcggctagaacattgggtttgtctcaatttgatacgatgcgttttatcatagtgccgcaagccataaagatagtgataccggcattaggaaacgaatttattagtttaatcaaagattcatctttggtatcagcaatatccgcaccagaaattacgtattgggctcaagctatgaatgcacaatactatgttgtttggacgccatatctcacagttgccgtactgtatttgattttgaccttgtcagcaagtcgactaatgaaactatgggaaaggaaaatggcgcaaaatgattaaagtagaacacatttcaaaacaatttggtaccaatgatgttttaaaagatattaacttagaagtgccagaaaatgaagtcgttgttatcattggaccatcagggtctggtaaatcaacattgctgcgactcatcaatcacttagatgttgcaacaagcgggtatatccatgttgatggtgaagatataacagatgagaataacgatatttctagtattcaagccaagatgggaatggtttttcaacattttaatttgttcccaaatttaaccgtgttagaaaacataacattagcgcctaagcgcgtgaagcgcttgagtgttgatgaggccaatgaagaggcaaaaaaactgttggcattagtcggcttatctgacaaagtgaatgcctatcctaaatctttgtctggtgggcagcagcaacgtgtaggaatagcgagatcgcttgcgatgcatcctaaatacttattgtttgacgagccaacttcggccttagatccagaaatggttgatgatgttcttgaagtaatgaaggatttagctaagcagggcatgaccatgatcgtagtgacccatgaaatgggctttgccagagaaatagctaataaggttatttttatggccgatggtgtggtcgttgaagaaggatctccaaatgcgatatttggcgcaccacagcatgtcagaacaaaggaatttttgggaaaagtattatgaaaaattgaggaactatatatgtcagaaaaacgcatacacattgtaggtgatttacacgaagttgctattcaaaaatttaccagtgcaggatatgatgtatcgcatagcccgaattatgatgaaaaaaaattattgtccttagcttctgatgcagcggtcattattatgactgatatggcatttgacaagaattggtttgatgccttgccaaatctaaaattaatcgcccgtcgtggtgtaggatatgataacattccggtggaatcagctaccaaacacggtgtgtgggtgacaaatacacccggtgcaaatgctattgctgttgcggaattggctgttactttgatattaacagttttgcgtaaggtcaaccaagcaaccaatagcgtgcaaaaaggtgaggtattaacatatccagcaagtttaatgggtcataatttatctgggaaaataataggactcatcgggtatggtcaaattgcgcaaaatttagaaaaaatattgcatggttttggggcgcatgtattggtttatagtcgaacaaagcgagaaacgatttatggtcaatttgtatcgtatgacacactactagcacaatcagatatcatatcgttacatattcctgctacaccagaaacaagtggtattttaaatcatgaagcattttcaaagatgaaaacgaacgctattctaattaatacagcacgagctgctttagtagatgaagaggcattggttgaggcaataaatactggaaaaatagcaggtgcaggtctagacacaacaagttatgagaccataaaaacagctagtcctttattgaatcatgatcaaattgtgattacaccacatattggtgcaaatacagtagaatccgaatacttgactgctgaaaaagtagtggcaagcgttcttgatttttttaacaaccaaaagccgatatacagattaaactagcacaattaggtgatgaaaggtacgccattaatgacaaaaaatattaataaaaatgttcataacacaggactgtcaggtattcgtttggtttctaattttataaaaaagccggtaaacgaggtcattcaactgacagttggtgaaattgatttaccaacaccatttgctaccaagcaagctggcattaaagcgattgagcaagatcacacaaaatatactgataatatgggtatattagcacttagaaggatcatcactgagtacgcgcaagaattttacagtgaaccttataatcctgttacagaggtactagtgacagttggtgcaagtgaaggcattgacctagcaatccgagcactagtgaatcctggtgatgaagtcatccttgtttcacctggttatactgcttatacgcaagccgttactttagcagggggtgttccagtagttgttgatacacgatcgagtaattttaggctattaccaaatcaattagaggaggtcattagtgagaaaagtaaattagttatactcaattatccgaataatccgagtggcgttgttttatcttctcaagagttagtagaattagctaatgtcatcaagagacatgatttatatgtgttgacagatgatgtgtataatcgtttagtttacgatcaagatttcgcaccatctattgcaagtgtgcccgatatgaaggaaagaaccttagtattaaacggtttatctaaatcgcacagtatgacgggttggcgcattggttatttattagggccagaatgtttaattcatgaattatataaaatccatcaaaccgatgttggctgtgcctcaagtatctctcaagaagctgcaatgacagctttaacagtggatcgcgataacccgtctgagatcgtgcccatatttagagaaaggcgagactatgttctgaaacgattggatgaaattggtattagctatattaaaccagagggaacattttatgtctttgcaaatattgaaaagtttggcatgacttcattagacttcgtgaagtttctaatagagacagtggatttggctgttgttcatggctccgcttttactgaatttggtgaaggatttattcgaatttcctatgcaatggatttatcaattctaaaagaagctttggacaggtttcaagctgccgtggctaaattaaacaatcaaaaaggcctcagctaagaggtggaagtgtggggcaaatcaaaagtgaacaaagaattagaaatttcaagatagcatggataggaacatttatggcgggcatggcatttagtgaagccatgccttttttggctctttatatcatgcaaattagtcattttaatcaggcacaagttagtttttatgccggtatttcatatgcggcttcgtatttagtagtgatattagtctcaccaatttggggtaaaattgcagaccaacacgggcgaaaaccaatgctacttcgcacagccgcggggatggggattgtaatcatcttattgagttgtgtgacgaatatttggcagattattattctccgtctttgtcaagggctttttgatggttatacacccagtgtaattgccttaattgctgctgaaacgccacttgaggagcgatccgtagtgattagtaaattatccaccggatatattattggcgggttaatgggcccgctaattggcggcgtactcgctacaatatttagcattagaatgaccttttttattacgggtataattttgttatgcgtagctttcatcagtttttatggtattcaggaaaactttcagaaaatcaatacaagtccgaccgaaaagttagcctcatctaaaaaggaaagcgtttggactgtgccaatcttaatattgctcagtgctaccatgctaattcagtttgtagagagtgccataattccttatgttagtttgatgattaaagatttgttattttcagagcattatttgactatcatgacgggtattgtttctgctttgccaggtgtcgcaacagctgtatttgcaacctttgttggtaaaatgagtagccattttggtactttaaaaatacttaaattgtgtgaacttgcagcaataataatttatgctttgcttggtatgaccaccagtttaatgttttttgcaggactaagatttttaattggaattgttaacgctggtatgacgccaatgatacaagtattattgtcaaaagttagtaatcaattgagttcggtttttagtatgagtttatcggcacaatcacttggtagtttagctggatctattcttggtgcatacctgagtcaatttatgccgttgaataatctattttacattgctagtggtgccttaatgatcagttacgtattattgaagaaaggagaactggacaattcaacggctcctacataaaaaaattggtataaaaaacgatctaagcaattagatcgtttttctttgcacaatcattgacaataaatgattcagcagttattttgatgaagaacttgaagaacttgaagaacttgaagaacttgaagaacttgaagaacttgaagaacttgaagaacttgaagaacttgaagaacttgaagaacttgaagaacttgaagaacttgaagaagaaataccagccgttagataggtattcaaagcagttttcaagtcgctgtctttaacactaacattgtttttacgcaaaatctttccgacaatggcttgtatttcactggtgttgcttgaatcattaatgaagtcagtcactatctgagttgataaggtactacgcaaactgctcattgaaggttttgttgttttcttattcaatttaatgacatagtaactgccacttgtaccagttacaggttccgttgagtagtcgccaactttatcgagcttgaatgctgcagtttgcacggctgagtcgatgcttgtatttgttgaattaaacgctggcattttaccatttgatgatttataagtactatctgtagaatactttttgtacactgtattccagttatcaccgttcttcaatgcagcaattgcttctttagccttagcttcattcttggctgtaatcatcgaaatcgtcgtgtctgagtggtagtttgtataagcagttttcagttgcttatcggttaccttatagttagccttgatggcagcgttgatgatcagattatttttgatattctttttaaattgggcatcagttgtgttgtttgatgccaaaacagtcttgaacgatgaaccgtactgcgccttttgtgcgtcgtaggcgttttgtacatctgtgtcagaaacttggtcgccatattcggcccctaggaccttattaataaccatattagcaaattcttgctgaccagctgatgatgttttgatatcttcgtaaaattgcttttcagtaattttaccaacttttgaagtcattaatgtttttgacgagttaaaaccaagaaagaccagtccgccgacaaaaacaacgacgagaagcccccaaataaattttcgcatgtgataatactttccttttctagatgcaatactaagtattttaccataaatgaatctaatgcgctttaaacttagataattcagtatttaaatgctcagtagcttcattaatacgtgaaatatgtggttgatttttgaaattcattttttcgatgtctgactgaatatcctcagaaacactctgtatctcttttaattgttctgttaattcatgctgttgtaactggagttgtttgagcaaagctgttatttcttttatattcgtgatgagatttttgaattgatcaaataatttcatattatttctcccaaacatcgttacgtcggatgttttaaaattgcgaagcaatactatcagcaatggcttggtactgttctgctgaaaaatgagcactgttatcaatagttggtgctaacacgctatttagattatcatcatcataacgaggaattaggtgccagtgagaatggataacggtttgaccagcagaaggaccattgtttgattggacatttagacctgtaatcttgtcgtcactggcttttatggcgcgcgcaatgacaggcaacttcaacaaaacttttttggcggtatcgtcatcgtagtcaaaaatattatcaacgtttttctttggtacaacgagtgtatgtccaggggttacttgtgagatatccaaaaaggcgagaacgtcttcatcttcataaactttataacttggtatttcacctgtaataattttgtcaaaaatatccaatgtaataatctccgtttctatttattatctttcattataacaaataaggttatataacaaaaatgaagtgttatttttagtaaacaaattgaaaagagacggtcattatctatatttatagatttcatacaaatatcatgtaatgcttgctataataaatgtatgggattaaaaattaacaatatatctggcgggtacgcaggcaataatatattgaaaaacgtttcttttgacgtgcctaatggtgaaatcgttgccttaattggtctaaatggtgctggaaaatcaacgacagttaatcatattattggagaactacagcctcagatgggatcaatagttcttaatgatactaatatagtatcagagccgacagcttttaaatcacaacttgcatatattcccgaacaaccaatattgtatgacgaattgacgttggctgaacatttacatttgatgctagcggcgcatgaaaaagacaatgagaatacttgggaacgtgttgtgtcattattaaccatgtttagattagaggataagttaaactggctaccaatccatttttctaaggggatgagacaaaaagtaatgcttgtatctgcatttatgttgaacgccccattgctaattgttgatgagccttttttgggcttagatacattagcgcaaagggatgttgtatctttgatgaaagaacaagcaaaacttggaaatagtattttgatgacaactcatttattagcttcagcggcaacatttgtggacaggttcgttgttctacatgatggtaaagtacgtttcgtgggcacaccttccgctttagcagaagaaaatcagttaacagttgatcatcttgatgatttgtttgatttaatgcaaaaggagttagctaatgaaggctagcgatttattttggcggcgctttcgagacgaacagcggacaagtgctaaatatctgcgattattatttaatgatcattttgtgatttttttgattattgctttgggtggtattgtgcttgcttatcgcgaactgctcagtacgccgcagtcgatgatgttttggcgctctaattggtggcaagtaatcatcattacgtggttactgatagggctacagataggtgatttaattacgtacttcaagccagcagataggctttacttattaggaaacgactcggaaattatcaagaaatatttgacgcgttctgtaaatttgagtattttatatgctagcgtatggcaagctgtttttgtcagtgctatcataccaattctattgcgaatttatgtcagtggtttattacgaattagttcgttgctgatttttgcaattagttataagttgcttctattgttatttgaacgagataagctattcttgaagcaacgcgtgcaaacgattacgatatttgaagcaaattcaacagctgaggggcttctcttccgtgttttattgcctagcattttcttagaatttatccttatattgacccagacgcaagtatatattttgatgagtgcttggttggtattgatggtagtaacggcttactattttcatatcagcaatcataaggcaaactcattcgcaatcaattgggccatcgcaacacaacaagcacaacaacaaaagcaaagagtattgcacttttttgcactttttgctgaaatccccaatcaacctaaatcaattaaaagacgacgttacctagatttttgtctgcaacgtttgataaagaataaaccagcaatgttgcgattatattggacacgtttagcgcgagacacggaaatattgcctttggttcttagattaataattgtggggatgattatcgtaggtgtgttgcagactgcacccgattggcttgttgctgtagttggtgcattgacagtatatcttgttaattttcagttattgccactattttcagatacgcaaaagaaaatttggacgcgtttgatgccaatcaccaattctcagaaacagagcgcatttattcaggtgcatagattggtgaactacattgtttgcacgttgttgattgttacggtagccgtgacaagtggctctttacaacggatactgttattatttgtattgttgattgtagttactattgcgctacaaaaaagttatattccatacatgattaaaaaaatgaaaaagtaacggagagattttatgcatttacgctcaaaaccttgggctagcgattggctggctgagcattcagatatagtgattgatcaagatcgtgcaacagcacaaattggacagtggcaatcattatttgaccaagaacaaccaatacatttggagattggtgctggtaagggtcagtttattcttggcatggccttggcacatccggaaattaattatattggcatggaaattcaagagacggcaattgccattgcagcacgtaagagctttgatcaggtcggcacattgccaaacttgcgttatatttatggtaatggtaatggtgttgagacatattttgaaaaaggcgaagttagcaaagtttacttgaacttttctgatccttggccaaaaaagcgtcatgaatcccgtcgattaacgtataagtcattcttgaaatcttatgaagcagttttgccagaacatggcgaagttgaattcaaaacagataatcgtcatttatttgagtattcaatggttagttttatggactatggcatgcgctgggcaccagaagattacacgctggacttgcatgccgatgaagacaaggtacagggtaacgttgagaccgagtatgaacaaaagtttatggctaagggtcaaccaatttataaaattaaagctcacttttagagcgacaagagttacagagtatcatataaacaaaaaacaacgtctaatttaggcgttgtttttgctttctggggacatttggagacttgaagataaaaaggtcaatgctatctggtcttgttcctgttccttttctttcaacatgtgagcataaacatctaaggtgatgcgagtattcttatggccaagcctttttgaaacgtaatcgattgatacgtcattgtataataaaaagctagcatgtgaatggcgtaaatcgtgaaaccttattctcggtatattgagtttttttaagatgtaatttagtcttctggggaattgtctattgtactatttttaaattttatatcattcatagttagggcggctatttctccaagcttggcacctgcttctagggctatcaaaataccgagctcggagtcattttcaatatgctgataaagattggattgttacttgacaaaatcttgtgcagataaaacatcattatgtgctttgcttttggttgacctaatcttgacacgagaccaattatccctctttatcaatctatcaatatgggcgttttttagcgatgatttcataacgtcccaaaatttagcaacggtggcgtaagcaaccgttttcctatattaatttagtttatcttgaataaggggagtggttaacctatctagctttatacatcaaatgaatttataacacgatgatactcgctaatgtatctttcttgggtatgttctcttatgtctggtttgcgatatcgttcaaaagtattcgggtaaggttatcattgaaaaattgctatcacaaatccaaataagagaggaaactgataatgtttaatttactaaaagaatatcattccgattttttcacgttaaatgacattaagcaatttgtaatcatatgctggataacaccaatagagtatagttgattacagataccaattatgtaccgtattgattaaagaaagtgaatgaatgcaaatgccacatgatttgttgagttggctaagtgtggggtctattcttctgggtggtttgtggtgggtattgaagaataccattgtgaactcaattaatggattgagaacagatatagctagcttgaaagatgagctaaaaatatctaatagcatcacggacaaccatgagatacggcttactaaattggaaacgtggaaacacgataaatgggaggtttgaaaattgaataaattaaaacgatgggtagtcgcttcaattggagcggttgccttttttggtgcaatgatcacaggcgtgtcagccaatactaatggtattgatgttgccagttatcaaggagatacaacaagttatttcaattcgtttaagcaagttggcgataactttacaatggttaagctaggtggacgaggaggcggtgagggtgctcattatagtaacccgaaagcctacgcacaaatccacaacgttgatgcagttggtatgcaaacaggcggttacttctgggcgcaagtaggtgactcagtcagtgaagctacttattcagctcaattagccgttcaggatgcacaaaatgcaggactggctaaaggttcatatattgcgatggattatgaagctggtgctggtgcaaataaggccaacaacacaacggctattcttgcgttcatggatcagatttatgcctcagggtataagcctatgttttatagctacactagctatgtcaactcatacgttgatttaagccgtatcaacgctcgttatcctaacgccttgtggttagcttggtacttaactacagcacatcaagcaacaccacctatgcaatatttccctaactattccaatgtgaagatttggcagtacgcagacaatcattatggtgttgatgggaatgtcatggtggttggttcattggataacaacaaaccagctgagcaagttgcatctaagcctagtcaatcaacgaacacaccaagtacaccagctaagactcaatacgctacatttagtggtgtatatgtcgctgattactgggtaggttataacaacaagatgtatggtgtgaactttgatatgagtatcaagcctattgattacaacaactatattcctatttcagccatgacattgactgataaatatggtaataagttgagtaatcaatatatccaagggaacaacggacgtatggagtacttcactttgaatgggaagtacaaggtaattagccaaacagcaacaacggttaatgttgaaatcggcggtgaacccgttagtatgatgaaggcgtttgccacaattaaatgatttaaggagaacacatggatacaaatacaattactaaattgattacaacgattgcgattgcagctattccgattatcggtggctatatcgggaaagtgttgctaggcaataagcaggttgttaccttgattcaagtgctatcaccactggccaaagatgcagtaatcgcgatgcaaaagctaggcgttactgagtatctagaaggtgaagccaagaaatcaggagcggttgcaatcgttaagcaaatgcttactgcactcggtctatcagatgccgatgaaacattgattaaaaatgcagttgagaaagaatacgctttattgattagtgagttagatcaaacgtatccccaaatgaccgaggaacaagctaaggaacaagagcaagctgaacaacagcaaagtgaattagccaaggctgatgagctagcgaaagcacaacaagcattagctgttgcacaagaaaaggttaatgccttacaaaattaaatataacaaaaaagctcaactagattaaactctggttgagctttttttatttgttttttggggctgattatgagaattataagcaataaatccagtcattaatgccccaaaaagtgtgatagttcctgttgtaaaacctgaaatagttgattcggaaaataacaatccatttgttaacgaagcgtaaacaaataattcaaagatactaaaatacgaaccaatgaggaatataataattaggaatggataaatcaataatattacagcaactccgatattgacttgaaatactttatatactttcacagcgttaaaaattatatatattgcaaatgataaaccaaaaaaagatagcatggacgtgatgacggatggcaagagaccattagactttccggctattaacatgtaggctacaatcgcaaaagcaattataaagaaacaggcgaataaatttgtagttaaatctgattctttttcgggtaaatcaggcaatattttagactttttcaacattctaggcgcagttaaatattcataaataaacattaaaataactaaggaaagaacaaaaaatagtacttcaaatagcgaaatatggttaatgatagtaattaaaaatgtatccatcgtctctccatttcaacatacaatataaaataaatactatattaataattatttatttgcaagcaagaacgtttgttcgtataatgtcatagaggtgacattatgaactacgacgacaaactaatcgaagaaatccagaagcggttcacgaagaagaagaacaccttgtattgggtgcgcatcgtgtaccaaagatactccaagcagttaaacgtgttttttgaatacgctaaaataggcatggccacacactctgaacaaataggcagatacgttgaatctgaaaaggatcgtatgcctgaattagcgaaacgtatcaaaacagagacaaacgtaagtgtggaacttggtgatttagaataatatgaatttttaattattgtatttgatgattttatcagttaaaataatcatgtaattgtagagattatgattgcatggcctgatagcattccgagaagctttacccctatcaggtttttttattacaaaactatataaaaaaatatttcagaaccataaagtgtataataaatttaagcctaacagactttcttcgctctatacaaaatcattacctgagttatgatttctcgtcggtaatctgttaggctttttatttgcataaactcaagtgaacatagtagaataaattataccaagcaggcatgtagactccatgataatatcctccaagatgattatcgatttattacaaatcctgttaggtttttatttagatgaaactcgttaaaaagccggatagaaatcaatctagtcggctttttattttggggaaaatttggggacttcctatgaattttgtgaacttctatacggtggttaaattcattaggatacctttataacagcttataagcattgtaagaaatttaaagggcgttgagaccgagtatgaacaaaagtttatggctaagggtcaaccaatttataagattaaggctcatttttagagcgacaagggttacagagtattatataaacaaaaaatatgaacttcacctcgaaaattgagtgtgaagtttaagtggctaactggttggcaagatttcggtattgaaccggaatgcttccggccattttttttatccgctcgttattgtagtaatagacatcggtttctttattgatgatcgagttagaattaacttctgagttggaagagtattacttaatagttgtgaaatgtttgttgtaccagggttaattgagcactcaagtgttttttatttttaaatcaagtaaaaaacaccatcaattaagatgatgtttcattatttatttgcctgatattccgtctataaagccgtgaatgaagtcaggtactgcagttaataatgttattatgaatgcggcaataattgctgtaagaaaaatagacacccatattttttgtgtttttgagcgtatttcatatgctggccttaaggtgagaaatgaaccaacgccacttacaaacatgataagaactagtatttcagtaataatatttaacatgtttccccctatttgatttattaaaagtatatcactaaaacaatgaatggaaaatcaaataactacctataagaaactaagcaaaataattattgccaatcatattaaaattgtatataatcattatgtaagcgttgccaaaaaatgtttacaagaatgatattcatccataaatgtatatcaataagcttggtaagccgagaattactgagtttgcaaggctttttcttgagtgaggattaagccttgttttttgttaccaaaagcctgcaaccagaaagattcgctaagggtttttcataagcaaggcgatttataaagaccactacatttccaattatttgtattgtacaaatattttagtgacaagacaggcttagtgtgctaatatttagctcgtggtgatccaaatgcactatgtaatttcctgaaacttgattaatatacaaaatcataacaccgttgtttggatcacttaaaagtatcttcggatgctttttttgctgtctattggagggcgctatactatgacgactttaacaacaagtgaaatgggaccacttgctgattgggtggtttaggggcgataattgctatttttgtgggttccttttaccgttctcatgataaaaaaattcagattgagataaagggatatttgtatcatttcaaaaaagatatcaaacgtcctgttccacaaaacaaagatcatcggtccaaggaaaattacgaaaatacatattttaaaatcaatgttaaaaatgttggtgatattgatatgaaaatagttgaggctggtattactgacaaagagtttacttatgctgatacttggcaagatctgcgagaaaagaactatgcaaaatatagctttgagcccaacaaagaaattataggaaaaacagctttgcctcttaatatgccgtgggttgaggaggagttaggagtaattatcacggatcaagatgcgaaaaaaattaaggtctacgcaatagacgcgttagataatatttactacggcaagttgaagtttgttaatgatattgatgaaaaaattaaatcctggctatttaaacgcttaaaatgataattaaatttgaattaaataagttaattttaataataaacaattgaattttctattgatgtttcatgatatgctttatgcatggggaagaatttagtttgagtgaatatctcaaatagaacgagtgaaactcatttcaaagaataccggctagaagacattctggtcggtatttgttttgtcaattttgtcaagaaagttaacatattttatatctttaaatgattgatccgatatactaaattttgtaatgttatttagacattatcaaatgcccaaccatttgtatgttttatcccgaaactcaggttgggcattttattgtgtattaaattctaattgatgtattgtcgaacgtttaaccagctgttataagtgttattgctagagaaaatgtaattagcgtgctaacatttaggtaagatgtccctagaaattattaaatacactcccaaaatgtattgcttcttcccttcgggggcatcgtacatatgtgaatagcgaaattttctcattgtcaatactatttaaacaaataataattggactgaattgggatatctacgtcaagcaaaactcgcaaaaagtcttttcaactatcagctaatgatttgtgtataaaatggccagtgtgtaacatctggaaaaccaagaattaaaataaaattatttttgaacaaactaaatgagattgcccagcaaatactgttgtattctgccatcaataaaactaaaatgtgtgtatggtttttgatttgttatttgccacgaaaaccagaactctaatctttaaaccacgtgtctgctcatgccacgtggtttttttgaacataagatagtcaattgaccagggaaatacgttgttttagcctttgcataggcatagaataaaattgtggtttttaattatcccgaaaatcacaactcccaatgttaagaaccacgtctaacttctctagtggttcttttttactgtcattttttattagaaatgttacaatgaacttgtaacatcaaataaacctcaaggagaacgtattatatgtcagttgaagaaaagtttgataatgctaaggacaaggttgctggtaaagcaaaagaagttgaaggcaaggttaccggtgataagcagcgtgaagcagaaggtaaggcccaaggcttgtttggaaaagctaaggatgccgtaacggaagccaaagatgctgtcaaagatagtattgacaatttaaagaacgataaaaagtaattaacaaataaaaagcgcctagcttgcagtagttaggcgttttttattatgtaaaaaaaaattttaataattgcaaaatgatttaaatgtgatatcataaagatatggttaaagaaaaaaacatgaagtcaggcaacataccattgagaattgatcccaaactacatgagtttttggcggaacaggccagcaaggaggggaggtcattaaataattacatcacccaattactgatggctaactatcatccaagcaactttgaagaccgtcaatttgtgggtcaggtcatttcaggtaaagatattgatattaaaagcggtttggtcaacgtttctggtatctattatcgatatttgattgataatagtgctgttgctaaaagtgatgaagattacgtgattctcgaggcaaacgggaatatcttgacattacgacaaatcatgaaagattagagggagaagttatgcttttttttaagattgttccgcagaacaatgcgggtcttgtagagacgttgggaaaatatcgtgcccgaagagaggccggattacatttttatgtaccgttctttcaaacaattcgtaaggtaagtttggctatgcgcccactacgtctgcctgattactcggtgattactgccgataacgctgatattaaggcaagtgttactttaaattatcatgtaactaacgcagttaaatatatgtacgaaaacacggattcagttgaatctatggcacaacttgtgcgtgggcacttacgtgatattattggtcgcatggagttaaacgaagcgcttggttctactaccaaaattaatgtccaattagcggatgccattggtgatttaacgaatacgtacggtatcaatgttgatcgtatcaatattgatgaattacgcccttctgcttcaattcaagaagcaatggataagcaattaacggcagatcgtgagcgagttgctacaattgctaaggctgaaggtgaagcacgttcaattgaattgacaacaaaagctaaaaacgatgcattgatggctactgccaaggctgaagctgatgctacgaaaactcgtgctgaagctgaaaaatatcgtattgacactgttcaggctggtttagctggtgctgatgataagtatttccaaaaccagtcaatcaatgctttctcaactttggctgaatcatctagcaatttggtagttgtgaatggtcaggaattagatcagttgggtcaaataccagttgctggtaaattactagaaaaaggacttaaatgaaacatttactgatgagacaacacttgttttcgttgggcggaaagtttgatataactgacgacagtgagaacacacgctacaccgtttctggcagtacatttagtattccaaagtattttgatattctagatttgaacagtatacctattgcgcgtttaacgcatcaagtgtttacttttttaccaaagtttaagttaattattaatgagtttccagaagaagttgaaatcattaaacgcttttcctttttaaaaccaagatacgaaattgaaggacttggtctaagtgtagaaggtaatatctgggacatgaattttgccatcctgcaagatggacgtgaaattggctctgttgatcagcgctggttagcaatgacaagcacctatgacattaaaattgaggacgagtctttggaatctgttgttgtggcggtagtggtagcaattgattatgttaaagcacaatctcacaattctagttctgcaagttcctagaagaaagcgatattcttagaatatcgctttttgaatcgtgtttaaaacattccatgatataataaatggcatgaatgatttctatagaaataagaatatattagtgattgtgacaggtagcatttcagcttacaagtcagcaacattagtacgcgaatttgttaaaagcggtgctcatgttcgtgtgggaatgacgactgcggcccaaaaatttattactgtacaaacattagctgttttatctaaacatgatgtgttaactgatctttttcgtgatgagaaggctgcggttactcatattgaatgggctaagtgggcagacatgatatttgttgtgccggccactgctaacattattggaaaaatagcaaatggtatcgctgatgatgctgtgactgcgacggtaatggcatcacctgcggctaaagttgtcgccccaacgatgaacgatgttatgtttaataatgacgcggttgttcgtaatttgaatttattaaaaagtgatggttggtttattattgacccagcgattggtttcttagccgaaggttacgagtcgcaaggtcgcctaccggaacctgtgacaattataaatcaggcagctattcgtatacaggcgcgtggcggtgaactaaaaggaaagaaacttgttattacagctggcgggacacgtgaagcgcttgatccagtgcggtatttaacaaatcgttcttcaggaaaaatgggctatgctttggcacaggcagctgcagagttaggtgcaacggtggtacttataaccacaacaaaacgtgaagaattgtacggcgtccgagaaatagttgttacttctacacgtgacatgcatacggcggttgtgcaagaattttctgatgcggatgttttcatcagttcggcagctgtatctgattatcgtcctgcttcacaagctgaaaacaaaataaaaaaagtaggtcatgagaatttaacgattgaattaattcaaaatcctgatatattatcagatattggtcatatgaagaaagctgggcaaattgttgtgggatttgctgctgaaacgcaaaatgttctcgcgtctgcacaaaaaaagctatcaaagaagaatgcagatttcttaattgctaatgatgttagtaatgtggatagtggttttgactctgataataataaagtaacgattttatcacgtgataaagacccagaaaaaattgaattgttaccaaaaattgacattgcgcgggctatattagatagagtagttaaaacactcgcataaacatctgttttatgctagaataaactgttaaataacgttaaaatggaggcaaacatggcagaagaagtagaagaaaatacctctggatttaaccttggagatgttttattagcaccagcttatggtaatttagaaaaaccttttacaggtcaagttgaaaaaatttatgaaaactcattgttggttgagattacggaaaatgctccagctgaccaaccagcagttaacgaaatgaaccatcgtgcggttgttcgcatggatgaggttgaagtgattaaacacggccctgcgcctgaaaaatctgtaaaagacgaagataagtaaagatgttttggaactatgattaagcgagcttgagttgatggaagtcaagccatagtcaaaacggcgcgtactaagagtccaaagttaataaatttgagtggcgaaagctattagagtggtaccgcgggctaggctcgtctctttgttgatgaaaacaagaggcgagcttatttatttttagatgaataatgcctaaaatacggtataataagaatatcgaatttttgattataatgtatttttactaaaaatcataattaaaaaccaaaagggaaaaaaatggtagataatatacaaattgttgaggcacttaacgcagtgctaactgaccttactttacaagaaatttctgaaaaactagaagcaccaaaatcatctgaccttggagatgttgcttttccaacatttacattagccaagacattacataaagcaccgcaattaattgcagcagacatcgttgctgcaattgatcaagaaggatttgaaaaagttgttgctactgggccttatgttaactttttcttggacaaagtagctacgtctaatcaagtattgaagacagtatttgacttggaaggtgcctacggtgacaatgtggatggacagggtgccaaagtcacgattgacatgtccagcccaaacatcgccaagccaatgtcgatgggacacttacgttcgactgttatcggtaatgcactagcaaacatcacagcaaaaaatggttatgcaccggttaaaataaatcatttaggtgactggggtacgcaatttggtaaactaatatatgcttacaaagcatggggttctgaagaagaagtcaaatcagacccaattgccactttgttaaagtactacgttgagtttcacgaaaaagctaaggaaaatgactcactaaatgatgaaggtcgtgcttggtttaagaaacttgaagatggtgatgaagaggcacaccgtttgtggcaatggttccgtgctgagtcgttgaaagagttttctgaaatatacgaccgcttagatataacgtttgattcattcaacggcgaagcattttataatgataaaatggacaaggtagttgatctcttagaagaaaaaaatcttctagttgaatcacagggggcacagattgttgatttgagccatatcaatccaaatctaacaccggccatgattaagcgttcagatggtgcaactttatatatgactcgtgacttagcagccgcactttatagaaaagaaacatatgattttgcgaaatcgttgtatgttgtcggtggtgagcagcgagaacattttgtgcagatgaaggccgtcttatcattgatgggctttgagtggtctgatgacattgaacacattgcctttggtctaattacgtttaatggcaaaaaaatgtcaacacgtaagggtgatgttgttttactgaaggatgtattagatgatgctcatgaattggctttgaagcaaattcaagagaaaaatcctgctttgggtgataaagatacagtggcagaagaagtgggcgccggtgctgttgtgtttcatgacttaatgaatgatcgtaccaacaactttgactttaatttagaagaagttgtccgttttgaaggagatactggaccatacgtacagtatacgaatgcccgagcaaaatcaattttacgcaagacgtcggttcaattgacgagtgatgacttgaatttgactgatccagcaacatgggatattattacgacactgaacaactttcccaagacagtgcaacgtgcttggcaacaacgcgaggccagtattattgctaaatatgcgttgaatttgtcaagagcgtttaacaagtactatgccaactcaaaaatattaacagaagacgttcaattaaatgctcgtttggtgttggttaaatcagtgtctattgttttgacagaaagtttgagattattaggtgtcaaggcacctgaagaaatgtaactgatctggacagatcaagtgctatttaagctaactgttaaagtgatgcacaaaacggtagtaaatgatatatttttagataaccgtgcatcatgatacaaaggagaaatcaatgatttcaaaacaagaacggcaaaagcttattttagatattatccaggataatatcattgccagccaagaagaattgcttgctcaacttatcaagcatggtgttgagacaacacaaacaaccgtatcacgtgatattcgagcaatgaatattattcgccaaaagagcgacagcggacagttacgttaccagcaactcaatgatacaacgaaaaatgttcaaaatttggtaacgactaacgccgttgatgaagcaatcaaagaatatgcttcattcgtgactcacgttgagttcttaacgattattaaaacgactgatggtagtggtaactcagttgctggcattatcgatgacgcgaatttacctgaagttattacgacactagcgggatttaacacaatttacgttacaagtaaaaatgaaacagatgccgcaaagctagctgatcattgggcggaattgataggttgatgaatgaagtggttgaaagcaataagtcaaaaagtgtgggataagttaggaccaatttggcatcgttggcaatttggtcgcttgctgattattttatttttaacattatttttggtcacaagtgcctacttagcaattttagctaaaactgcacacgttaaaaatttagaagcaacgctctctcaaacggcaacagtttacgatgatcagggtgaaaaagcaggcgaattatattcacaaaaaggcacctatgtctcgtataataagatttcacagaacatgcgagatgcagttttatcaatcgaagaccgtaatttttatcatgagtatggcttctcggtaaaagggattgcacgtgcagctgttttattggttaaaaacaaaataaccggatctaatactatttctggcggcggttctacgttaacacagcaattggttaaaaatgcttatttgtcgcaagaacagacatttaccagaaaagccaaagaaatctttttgtccatgcaggttgaacaagattacactaaaaatgaaatttttacgatgtaccttaataatgcatggtttggtcatggtgtctggggcgtagaagatgcatcacagaaatattttggtgttcatgctagtgaattaacgacaacacaagcggctacactagcgggtatgttaactagtcccgccaaatttaatcctatcgattatccagaagcttccaaggctcgacgtaatttagttttgacaaccatggttgagaataaaaagatcacttcagcgcaggctagtgcagccaaatcgacgacggatacgctaaatgatacttatgatgattctggtgattataattatccttggtatttcgattcagtgattaacgaagccattaatacctacggtttaacagaaaacgatgttatgaatcgtgggtataaaatatacacaacgttaaaccaaaaggatcaaacgaatttacaaaatgatttcgataattcagcattatttaactatgttgatgacgcacaagcagcatctattgttttgaatgctaaaactggtggggtattggctgtagttggtggtcgtgaaacatcgcatactttccgtggctttaatcgtgctaatcaatcacaattacaacctggttcagcaatcaaaccaatggtcgtttatgcaccagctctacaacgaggttatagtattagtacaaaattgcctaaccaatcgatgagttttgggacgaacaattatacaccaaacaatgccatgaacgttgaaacggctgatgttcctatgtattcagctttggaacattcgtataatattccggcagtttatttacttaataaaatgggtgtagaggttggttataagagtggtactaagtttggcttaccattaaccaaaaaggataagaacctatcactagcactaggcggattgaccaaaggtgtatccccacaacaaatggcacaagcatacacagcttttgccaatggtggtgtgatgagtcaggcacattatattactaaaatagttgatgcgagtggcaaagtaattgttagctcaccaaaggcaaaacaaacacaggtcatcagtagtaaggttgcaaataatatgacacgtatgatgctaggtacctatacggatggtacaggtgttggatctgcaccatcgggttacactattgctggtaaaactggtactactgaaaatcctaatagtaccaataatgctagttcgtcaaaggattcatgggcaatggcgtatacgaaagacattgttcaagcaacttggatgggactggaagggaacaatactggttctttgccgttaggattaacgtctacaatgggaccactggttaaaacgtctttggaacaaattttgccaaatacggatcaaaccgcctttacagtaacaaatcctaacactacatcaagcagtacaagtcaaagtagtgacttatggggaacgattcaagatgatttcaatagtggcgttgacaaagctgttgaaggagcgggtcaattgtggaataatgtcaaaggattatttggtaattaatcgtttagattgattagtgtttcacattagttatgggttgtgatatgattttagtgacatagaataacgttaaaaaaaggaaaataacatgacagtaaatatttacgataacgccaatgaaatggcaaatattttgacagaaacacaacaatatattgcatggcaaaatgcatttaacgcaatacaaaatgacactgattctaaggcgttgtttggtgaattccaagaaattcaaatggcagtacaacaaatgatgcaaagtcagcaacaaccaaaacctgaacaagaaaaggaatgggatgctgttgctgcaaaagtacaaaaagacgaaaaaattaatgcgctgatggaagcagaacaggctttgaacactttgctaacggaattaaatgacatcgttacaaaacccgttgccgaagcatattctaagttgcagaagtaaattaagctcactatcaccgacagttatgctgttggtgattttatgtaaaggaagttatttatgtttatgaaatttttgaaggagtgggtttttccaattgccattgcaattcttattgttgtgcttattcgctcatttttattcacacgcgtaaaagttagtggaccatcaatggaaccaaatttgcaagataacgagaatgtgtttctaaacaaagtggcaagttataagcgtggagatgttattgtatttaacgctaaagatgaagatcctaggtaccagtctggggacgataagtatgtgaagcgtattattgcgatcccaggtgatacagttgaatacaaagcgtctaatctgtacgtcaatggcaagaaagttaatcaaagcttcattagtttgaatgaacgtacacagggaacggaaatgtcttttggtagcacatggtctcttaagacactttcctccggtacgctatggcagaaaaaggatcgcaataattctacagttccaaaaggtaagtattttgtcatgggcgatcatcggtcagtttcaaatgatggtcggtattttggatttgtagataaaaagcacgttgttggtaaagtcattgttccattttggaatagtaacaaaacagctaaagcaaatgtcaatcaagggaataaaaatttctttagtaagtaagttgcattaacttttaaaaaatgctatgattactatcaataaaataaaacctttaatcaggtccagagagacctgcaaggctttagatacttttggtgaagtgtacacttttaccctcattttctagaaccaagcggtcgctcagatcgcttggttttttgtataaagaagggtaatatgcgaaattatttgaatataaatgcaattaataaaaatgacgtgctacacttaatacaacgtgcgttggcgttaaaatcaggtgagcaacctaaaacaaaatcgataacggctgtaaatttattttttgaaaattcaacgagaacgcatagtagtttccaaatggcagagaatcaacttaattggaaacagatacaaatcgaccctcaaactagttcaatgacaaaaggagagagtttggttgatacattaaaaacccttaaagcgattggtgtggatgttgcagtaattcgtcactctcaaaattcatggtatgaaaacgtcttacggagtgaagggcatgcaattccacaacttgtaaatgcgggggacggtagcggccaacacccttcacaaagtttgttagatttagtgacaatttaccaagagtttggacattttgaaggtttgaaggttcgaattattggtgacctagcacattcacgagtagcgcgttcaaatgcagagatactcaacaagcttggcgcaacagtgacattcagtggaccaaaagactggcaaccagttgattttgattcatttggcgaacatgtggaccttgatgttggttggtcggaacaagatgttgtgatgtttcttagagtacagcatgaacgaattacacatactgaaaatcaaaatttttcggcaaaaaagtatcatgaagtgtatggtttgactgaatcacgttatgaaaatttgaaagaaaatagtattattatgcacccggccccagttaatcgagacgttgaaattgccgatgatttagttgaagcaccaaaatcacgcatatttgaccagatgaccaatggcgtttatgcacgaatggccattttagaatacgttacggagtaagtaaatgcaactaataaaaaatgctaaaattttatggaacaatcaactcgttcttcgagatattttaattgaccaaggaatcattcaaaagattagtaatcatcttgaaagtaaagcagctaccgtttttgatgccaaaggggccttcctttccacgggattagtagatgtgcacgtacattttcgtgaacctggttttgagtataaggaaacgattaatagcggatctaaggcggctgcacgcggtgggtttacgactgtgattgctatgcctaacttaaatccagttcctgataacgaagagaagataacgaatcaaatcgcacgaaataaacaaaatggtgtgattcatattgaacagtacggggcaatctcaaataatttgacgtcaactcaagtaaccaatattaaaggaatgtcagcagctggggccaaagcattcacaaatgatggtaaaggtgtacagacagcaaatactatgctccaagcaatggtcgccgctgcatcggttaacaaacctttagccgcgcatttggaagacgatacgctggttcatgatggtgtcatgaacgaggggaaagcatcaacaaaattagaattaccaggaattacaggattggcggaaagttcacaacttgctcgagatttggtactagctaaagctgctggcgttcattaccatgttgcgcatatttcaactaaggaatcggttgaattggtgcgaattgctaaacatgaaggtgttcatgttactgcagaggtttctccgcatcacttattattatcagaagaagatatcaattctgataatgcaatgtttaaaatgaatccaccactacgaactcagagagatcgtgaagcagtcattgctggattgttggatggaaccatcgatatggttgctactgatcatgcgccacatggaaaagaagagaaacagaagtctttccgagaggcaccatttggcattaccggaatcgaaacgagtttccaactgctttatacttatttagttaaaaatggtgtgatgactctagaaactttgcttgagcgaatgatcactgctccagtcagtgcatttcacttgcaagcgcccactagtatcgaagaaggtgcgcgagcagacctcgctctgtttgatctagataataactatgaaatcgatactaaaagctttgaatcgatgggaaaaaactcaccatttattggatggaaagtgtatggaaaaacactggccacatgggttgacggtgaaattgtatataaggataacgtaaaatgaaaaaacgctacttattattagaaaatggatcagtatatgaaggggaagcttttggtgctgatgttgatatcatggccgagttagtttttaatactggtatgtccggatatcaagaatcaattacagatttatcataccgaggtgaaattattgtatttacttacccactaatcggtaattacggggttaatcgtgatgactttgaaagtttgcgaccagctgcatctgcgattgtggtgcacgaaatcgctcgacgaccaagcaattggcgcaaaacaatgagtttgcctgaatgggcagaaaaaactggaatgcccggtataacgggcattgatacgcgcgctttaacaaaagagttacgtaatcagggttccatgaaagcagcgcttgttgatgaaataacggacgaagtcgttgcgagactaaaagcgtttgaaacatcgaaaacaatggttgcagatgcaacaacaaagacacagtatcaaaacccaactgatggtgtatcaatcgcgctcattgattttggactgaaaaattcaattcttcgctcgcttgccaagcgcggtgttaacgtgatggtatttcctgctaatgtggacgcagaaacagtattggcagcgaaccctgacggtatcttattgtcgaatggacctggtgatcccaaagatgtaaaatatgccattccaacaattcagaagctacaaaagcatttaccgttaatgggcatttgcttgggacatcagctgttcgcaatcgccaatggcgcagaaacttacaaaatgaaattcggtcatcgtggttttaatcatgccgtgcgcacgatttccaaagcgagattagattttacgtcacaaaatcacggctacgcagtagaacgagcaagcttagagaaaacagatctagttgtgacacacgaggaaattaatgatcagactgttgaaggtgttcgtctaaaaggctacaatgctttctctgttcaattccacccagatgcagcacctggtccacacgatgctgaatatttatttgatgaatttttggatatgatagctgattcaaagaaggagactacaaatgcctaaacgtcaagacattagtaaaatattagtgattggttctggaccaattgttattggtcaagcagccgaatttgattattctggcacacaagccgcgctctctttaaaggaagaagggtatcatgttattttagtaaattctaatccggcaacgattatgactgacgctgaaattgctgacaaggtatacattgagcctttgtcaattgactttattgaacgtattttacgtaaagagcgtccagatgctattttgccaacgctaggtggtcaaactggattaaatatggctaaagacctttccgaagcgggaattttggatgaattaaatatcgagttacttggaactaagctatcagcaatcgaagaggccgaagatcgtgaagaatttaaagccttgatggaacgtttgaatgagcccattccagagtccatcattgcaactactttagaagaatcacttaattttgctgacacacatggttatccagtaattgttcgtccagcctacacgttaggcggtaccggcggaggtattgctcaaacccatgaagagctttcggaaattacggccaatggattagaactttctcctgtaacacaagtgttgattgaacgttcgattgcgggttacaaagagattgaatttgaagtgatgcgtgacgctaatgacaacgcattggttgttgcttcaatggaaaactttgatccagttggtattcatactggagactcgattgtgactgcaccagttcaaacattatctgatcgcgaagttcaaatgatgcgtgatgcagcgttaaaaattattcgtgcattgaaaatcgagggtggtgtcaatattcaaatggcacttgatcctgattcatacaaatattatattattgaagtcaatccacgtgtcagtcgttcttcagcgttagcttcaaaggcgactggatatccgattgccaaaatggctgcaaaaattgccgttggcttaacacttgatgagatcatcaatccagtaactggcacgacaaaggcagagtttgaaccagcattagattatgttgtgtttaaaattccacgctggccatttgacaaattttcaacagcagatcgtcgcctaggcacgcaaatgaaggcaactggtgaagtgatggctatcggtcgcaatatggaagaagccatgttaaaggctgttcgctcactagagattggggctattggtttagatgatataacctataagtatctttcagatgatgaactgctagcagcattaatgcctgctcgagatgatcgtttgtttatgattgctgatttattgcgccgaggtgtttcaattgaaactattcatgataaaacactaatcgatgaatttttcttggataaagtattgcatgttatcgaaattgagcaagaccttgccagccatgttggagatattgatcagttgcaatatgctaaaaagaatgggtttgctgacgaaacaattgctaaaatctggggcaagacagctgctgatattagaacactacgcaaagataaaaaaattaagccagtttataaaatggttgatactgttgcggcagaatttgaatcggcaacaccgtattattatgcaacctatgaacaggaaaatgaatcgattattagtacaaaaaaatcggtacttgtactaggttctggaccgattcgcatcgggcagggtgttgaatttgattatgcaactgttcatgctgttaaggctattcaacgggctggatatgaagcgattattatgaattctaatccagaaaccgtttcaacggatttctctatctcagataaattgtattttgaaccacttaccttggaagatgttctcaatgtgattgatttagagaatccagtcggtgtggtggtgcaattcggcggacaaactgcaattaatttagctcaacctttgttagacaatggcgtaaacattttaggaacctctgtagaggatctaaatcgtgccgaagatcgtgaagcatttgatcaggtcataaaagaacttactttaccacaacctgttggtaaaacagcaaccacagtagacggtgcattagcagctgcacaatccattggatatcctgtattgattcgtccttcatacgttttgggtggtcgagcaatggaaattgtttcttctgacgatgaactccaggactacatgcagcgtgcggtcaaggtttcaaatgatcatccggtattgattgattcgtacttagtgggacaagaagcagaagtagatgttttgtcagatggtgagacagctgtaatcccaggtattatggaacatatcgaacgggcgggggtccactcaggggattccatgtcagtttatccaccacaatacttgtcacaaaaggttcaagatgaaatggtgcaagcctctattaatttggctaaagctatgaacacaatagggttgatgaacgtgcagtttgttatccatgaaaatacggcatatgttatcgaagtaaatccacgtgcatcacggacagtaccgttcatatcgaaagtcacgcatcttccgctcgctcaattagcaacaagagttatgttaggtgaaaaattgtcagaaatgggatttgagacgggacttgttcctaacgatgatatggtgcacgttaaagcaccaatattttcgttcacaaagttgcccgatgttgattctttgctcggcccagaaatgaagtctactggtgaagtcatggggtcagatattaacctgtccaaggcgttgtataaggcctttattgcttctaacatcaaagtaccacgttacggcaatgtcttattcacagttgctgatgatgacaaagaagaggcgctcgaattagcaaagagattcaataatttgggatttgctttgtttgcaactgccggtacgggtgcttacttgtcagacaatgacttgcctgtggaagtactcgataaaatttcggaatcagataataatgcggttgcagcactgcgtcaacaaaaagtgcaggttgttattaacacaactcaagcagatgaccgtgctgaaagcgatggccgcttgattagaaatgctgcgattgaaaatgccgtgcctttgtttactgccttagacacagttagtgccttcttagaagtattagagtcgcgcagttttacagtgaaagaaatgcactaaactttttcaaataagcttcggcttatgtgcataggaggatcataatgacagaacagccagtttttattgctttggactttcctgatgcagctactacttacaaatttttgaagcctttttcagatctagtagaaaagccagcattgaaagttggtatggaacttttttatcgtacgggaccagagttcatcacagaactacgtgtattgggctatacaattttcttagatttaaaactttacgatattccaaacactgttggtcgtgcagtcgctaatatatcaaaactagatgtacaatatttaactctgcatgcagctggaggggaaaaaatgctagaagcagctgttgctaataaaagtgaagcgttaaaattacttgcagtgacgcagctaacttctttttcagaagctgagatacaagagatacaattaaccacagcaactactgaagaaagtgttgcacatttggctgagcttgcttactcggtgggcatagacgggacaattagttcacccttagaggctggtttaattaagtcacacacgaatgatcgatttttacgtatcacacctggtattcgtttagctggtgatgaagctggagatcaagtgcgtgtgactacgccaggggaagccaagaagttgaattcaactggattagttgttggtcgatcaattacacaatcgaccaacccagtggctgcatatcaacgtgttgtcaatgaatggagaaaataaatgacagactataaacaacaagtagctaatgatttacttgaaattggtgccgtaaaattttcgccagaagaacctttcacgtgggcctcgggtattaagagtccaatatatacagataatcggatgaccattgggttcccttcggtacgtcaaaatatatacaaagggctgtctgaactaataaaaaaagaatatagtgacgttgagattattggtggagtggctactgcaggtattccacattcagcttgggtagctgaagaattaaataaaccaatggtctatgtacgttcaaaacccaaagatcacggggcaggtcgtcaaacggaaggtgcattggtaaaaaatcgtaaagtcgttttgattgatgatttgatatcaacaggtgggtctgtgttggccgcagtaaatgcggtgcgtaaggagggagcaagtgtccttggtgttgtttccatattttcttatgaattaccagctggtaaaaaaaattttgctgaagcaggactaacatttaactcactgacaacatattcacaactaattgaaacagccgttaagcgtggggatctcgataaatcacaagttgaaaccttacaaaactggaaggaaaatccaaatgcttggcaagcataataaaaaggctcatcagagatgagcctttttatttggtttttaataaatagcgtcgcgatacagtccgattacttttcctaaaatagagactttttgcaaaataattggcgccatgctgttattttcaggttgtaagcgataatgatcggcttcacggaaaaaacgcttaactgtcgcttcattgttatcattcattgcgacaacaacatctccattatcagcattctcttgcttacgtacgataactttgtcgccatctagaatgccaatgttaaccattgaatcaccatgaacattaagcatgaataggtcaccatcaaattgcattaaattatctgggatagggaaaaattcagttgcttcttcttctactgccaaaattggtgtacccgctgtaaccattccaagtaccggaatttttccgggtgtggttgaaatcccaagcatctctaaaccaatatcggttacttcaatcgcacgagctcttggtttagaagcatcttttaaaagataacctttttttaccagacgttcgatgtgaccgtgaatagttgaagaagatgataatccaacagcttcaccaatttctcggacggttggtgggtaaccattttctgattgtgcttcatgaataaatcgaagcacttgaatttgtttgctttcttgtgtaattgccatgatgggtttcctacttgttaaatttactatcatcagtataacggaaaaacacgaacaaatcaaacgtttgttcgttatttttttaaaaattcaacctaatattaaataaataataaaaaattcgtgttatttatttttgtaacgaacaaaatggttcatattgaaaacgttaactctgcaagttattatagcacgcctttgctggctgtgctataataattatcagacattttagtaaggagaatatgcatgattagcacatggctagcaattttgattgcagtgttaactttaattattggtttggtcggtggctttttcttggcacgtaactcaatgaagagttatcttgcaaaaaacccacctatttcagaagaaatgatgaaatcaatgatgatgtcaatgggacaaaaaccatctcaaaagaaattgaaccaaatgatggctcagatgaagcaacaaagtgccaattcgcaaaaaaaataagccaatcggcttattttttttctgaacgttttggatctacatatttccaagttgggtcaatctcagcatctaattcttggaaagctgcttgcatttgctcagtatatttagcaatattttccttgttcaatcggtctttacgatcaataataattggctcaccaaaattaactgtggtattattacgtttgaaaagttgactgaactttacagggccttgatatacagctggtacgattgcctttccagccattcgtgcaattagaatggaacctgattttaaatcatcactgtgtctagaaccagaaggaaacattattaaagagcgattgccatcttttaattcgcgtacaggtattttgatgacgcttgggccaacattttcacgatcaactgggaatgcgccggctgatttgattaaccatgcaagtggcttgaatttaaataattcaatttttgccatgaaaataaagtgttttgggtaagctgccacagcataccatactggatcccaccaagtgcggtgtggaccaactagcacatagttattgttttggggtattctgtcgcgattcatgtatttaatgcggccagtaactgcccatattaaagcaacagcaatgccgcgtaaaaaatcatagaatttcatatttatttacctcataaattaatcatttcaattttacagataaacagaaagaaacgcaaatgacacaaccatttcttaaagcaaatgaacgtattgatggacttccatcacaaaatattaatatcatccagaatccagacatgttttcatattccttagacgcgattttattagcacattttgctgatgtaaagggaaaagggaaagggttatctgttgatttgggatcaggtactggcgcggttggccttttttacgctccaaaagtgactggggaaataaagttagtcgagatacaaccagaattagctgaaatggcacaacgtagcattgaactgaacaatttacatgaacgtgtttcagtcgttcaagctgacatgaaaaatatatttaatgaaattaaacctggctctgttgaaactgttctgactaatccaccttattttcccttaactgagactaccaagactaatatagataaacattatgaaattgcgcgccacgagttgatgattaacttacctgaactggcccaaattgccaataaactgctgaaaaataatggtaaggtctatatggtacaccggccggaaaggctagcagatatatttgcagcgtttgctgcacgaaagcttatgattaagagagttcaatttgtttatggaaaggcaaaccgcgaagccaatatggttttaatagaagccattaaatctggccgaccaggtggcgtgcgcattatgccaccccttatcgcctatactgatgacaatgactatacatcagaggttcacgacatcctttatggtaaagcgtggcatgaatgaagtattattatttttatgttttatatacagcggatggttatttttatggtggattcacggataacgtacaacgtcgtctagcgacacatgagtctggtaaaggggctaagtttacccgcgtaaagtcgcggcatccattaaaattgattcactatgaagagttccagacaaagagcgaagcgttaaaagcagaggcaaattttaagaaattaacacgaattaacaaggaaaagtatttattagtacaccacgtaatcaaaatttggtaatatgcttgtcaaggaaccataaataatgtaaaatgtaatatgttgtgaaaagcagcaaatacacacgataaatgagaacacgtaggtgcagaaatgtcagcgtgaacaacgaatttgtcggcggaaaaacctaggaggccatatcatggcagttatttcaatgaaagaactcctcgaagcaggagtacacttcggtcaccaaacacgtcgttgggacccaaagatggacgaatatatctttacagaacgtaatggtattcacatcatcgatttacaaaagacagttaagttagttgacgaagcttataactttattcgtaacgcttctactgatggcgctaacgtattattcgttggtacaaagaaacaagcttctgatgcgattgctgaagaagcaacacgtgctggccaatactatatcaaccatcgttggttgggtggtacattgacaaactggaacactatcaagacacgtatccaacgtttgaaggatttgcaaacaatggccgaagacggtacatttgagcaattgcctaaaaaagaagttgttttgttgaacaagcaacgtgaaaagttggaaaagttcttaggtggtattcaagacatgcctggcttgccagatgtattgtttgttgttgatccaaagaaggaagaaattgccgtcaaggaagcaaacatgttgaatatcccagttgtagctatgatcgatacaaatgctaacccagatgtagtcgatgttaagattcctgctaacgatgatgctattcgtgccgtacgtttgatcacatcaaagattgccgatgctgttattgaaggtcgtcaaggccaagattcagcacctgaagatgcattcgttgaaggtgacgaaaacacagaatcaatcgaagaaattgctaacatcgttgaagaaggcaataactaattaattttattctataaataccgttcctagcggacctgttcgggacgcggaatggtattttaatatgttataataaaaatacattaaactattttagaggagcactataatggcaattactgctgcacaagtaaaggaattacgtgataagacatctgttggaatgatggatgctaaaaaagcattggttgaagctgatggcgatctagacaaggcaattgatttattgcgtgaaaagggtatggcaaaggccgctaaaaagggtgatcgtgtcgctgccgaaggcatgacagctgttgccgttaagggtaaccgcgctgcaatcattgaattaaactcagaaactgacttcgtggctggtaacgctgaatttaacgaattgcttaacgcagttgccaacacaatcgtcgaatttgcgcctgctgacgttgaagctgctttggcacttgaagttcaagaaggtcaaactttgaacgacaaaattatcggaacaactcaaattactggtgaaaagattactttgcgtcgtttctcagtagtagaaaagtcagattcagaaaactttggttcatattctcacttggcaggctcaatttcagctttggttgttgttgatggtgcttcagaagaagctgccaaggatatcgcaatgcatgttgctgctattgcaccacaatttgtatctgatgatcaagtacctgctgatgttattgctaaggaaaaggaagtgcaattagcttctgaagatttgaatggtaagcctgataacattaaggaacgcatggtcgaaggacgtatcaagaagttcttggctgaaatttctttgttggatcaaccatttgttaaaaatggcgaccaaacagttgcacaattcatttcttcacagaatggatcagttaagtcatttgttcgttaccaagttggtgatggcattgaaaagcaagtcactgatttagctgaagaagttgctaagcaacttggttaatatttaaaaactactaattgccattgatttttttatcaatgcagctaattagttaaaaagtgtactattataaatagcgcacttttttttcggaaatttttcggaatttttgatatacttgtataagcaaataaaagaggttaaacatgactgatattaagtacaaacgcgttttgatgaagctctctggtgaagcattggcaggggacaaaggtcaaggcatcgatcttgagactgtttctgcaattgctgaagagctaaaagatgtccatgacctaggtacacaaattgccattgttgttggcggtggaaacttgtggcgtggagagccagcatcaaaaattggtatggaacggtctcgtgctgattatactggcatgcttggtacaacaatgaatgctctagttttgcaagattcattggaacgcgctggtgtccaaacacgtgtgcaaactgctattacaatgcagcagattgctgaaccttacatacgtggtcgtgcgattcgtcatctagaaaagggacgaattgtcatttttgcagcaggtacaggttctccgtatttctctacagatacgacggcagccttgcgtgcaaacgaaattaatgctgatgccatcttaatgggtaaaaatggcgttgatggtatttatgactcagatccaaataaaaatgctaatgcggtgaagtttacggaattaactcaccttgacattttgcaaaaaggtttgaaagtaatggattcgacagcaagctcactatctatggataataatatgccattggtggtgtttaaccttaacacaccaggtaacttgaaacgagttgtgcttggtgaagccatcggaacaacagtaacaggagaaaaataatgacttttgatttaactaatgctaaagagcgtatgaagggggcacaagaggcacttcaacgtgaattagccaacatccgtacaggtcgtgcgaatcccaatattttgaatcgcgtcgaagttgaatattatggggcaatgacaccattgaaccaagtggcttcaatttcagtaccggaagcacgaatattgctaattacgccgtttgataaaagtgccttggaagcaattgtacatgcaattaacgtgtccgatcttggtttgaatcctgcttctgacggaaatattgtgcgcttggcgattccacaaatgacagaagaacgtcgtaaagaacttgctaaagaagtgaaggctgaagctgaaaaagctaaagtttcagttcgtaatgttcgtcgtgatattatggatgatattaaaaaagacaaagacatgcctgaagatgatgcccgcaaggccgaagatcagacacaaaagttgactgatgaaaacatcaaagcaattgatgaaatagcagctgaaaaagaaaaagaattgttaacaatttgattttcgtaagatattgcgatcatgcttgacttggataaatccaagtctttttatttaggagagggatgtgctgaggagatatttgagatattggcgggaagcatttgattttcatagtggtgcgtatcgattggatttttggtgggttcatatcgtgaatacatttatttttgcatctattttatttgtatcaattcttttttttaactcttggtcgctagcaaccaagttatctggaacattcagtatcttaataactattccaaacttatccttatttattaggcgattacgagataccggatttccagtacagacaattatgtttgtactgatgagcccgtcacttttaggagtgagttttggcattttagccagttttcgtttagttattttggcgccaattgcatttttaatatacttcggttggctgatttacttggtttcaaggcgttctgcttattggacaccgactttaagtaaaaagcaaaaatcattttatgcagctttaattagcgctgtaataattttaactgcctgttttcaggttgctgctttaaagcatgtcacacatgaatttagagctgctgcgcaaaagtatattcaggaacagcgtcaggttaatgaaaatcgaggtaagtccgcgtcatcaagttattctactaaaaatggttctatgagctcgtcaacccaagagacagatgataacataccagaagccagctcagcatcttcgatacctgaaaaagaagttactgaacttccagacgattctgagacgacagcatacagaggattaacagaagatacaataggagatgcaacatttggtttctttaaggtccatgggacttgggaacaagatgcagcttctttgcagtggttgcagtcacaacaaaacgtaatgattttaaccagcactcaaggtcagggatttggtgttgattttgctagttttagttttaaaaaaattacgggacaaagttatgtttcattagatcaagtcgacaatatacaagcctctcgaattgatggtacctaccaagatactacctctgacagtattaaggctatgacttatttagagtggcatatgccagatggtcatatccgagttgtgtacttaattgcgccatcaagaccattgcttaatttaattgttaaaacattgtcagaaagttttcgagcaacttaatgtagaaatttttacttgacgatttgtcgtagagagtgcataatatcattattgagttttgtacgtgatgaagccaagtggcgttggtggaacggacaaacagtcgagtgtcgggttttataactcggaagtcaggtggaaccgcgcgtaagcgtcctgatgtcaattattttggcattggatgaacttacacgcggttttttgatgctggtaaatataacaaaatatcgataccatctgtgctaaattgtcggtaaatttttaaggaagaacgattatgacaaacgaaaaactatcattacaagatattatcttgaccctacaacaatattgggctaaacaaggcgcaaacttaatgcaagcatatgacaatgaagttggggctggaacacaatcgccatatacatttttacgtgctaatggccctgagccttggaacgctgcttatgttcaaccttctcgtcgtccagctgatggccgctatggcgataatccaaaccgtttgtttcaacatcatcagtttcaagtagtgatgaagccttcccctgaaaacattcaagagctttacctaggttctttagaagctttgggtattaaagcattagaacatgatatacgtttcgttgaagacaactgggaaaacccttctatgggtgctgcaggaattggttgggaagtttggctggatggtatggaagtgacacagtttacttatttccagcaagttggtgggattgaagtagattctgtgacagcagaagtgacttatggtctagaacgattagcatcatacattcaagatgtaccaacggtttatgatcttgaatggggtaatggtgtgttatacggtgatattttcaaagaaccagaattcgagcattcgaaatacgcttttgaagaatctaaccaagatatgttgttgcgccactttgaagaatttgaagcagaagcaactcgtttattagatttgggcttggtacatccggcttatgactatattttgaaatcatcacatacatttaatctattagatgcacgtggtacggtttcggtcacagaacgagctggttatttacatcgtattcgtacaatggctcgcaaagtatcgaaagtatttattgaagaacgagctaagcttggttttcctttgctaaaagatcagacattacgggataagtatcttggtaaaaacggtaaatacaccaaagaaaatgcctgatagtaacagagataaaatcaatattggagaataactcatgtcaacatttttattagaaattggtcttgaagaagtgccagcacatctggtcacaagctcagaaaatcaattaattgaaagaacaagaaactttttagctgagcatcgcttgattgttggtgccattaatccttattcaactccacgtcggttggcggttgaattaaccgatgtagcggaaaaatcagaaagtttgagtgaagaaaagcgtggtccgtcaattgaaagagcaaaagatgccaatggtgagtggactaaggcagcaatgggatttgcacgcggtcaaggtgcaacaccagatgactttgaaacaagagacggctatgtgtggttaacaaagcatactgaaggtgttcctgccaaggatatcttggtcaaaattggtgccgaggtggtttcagagatgaagttctcaacgtacatgaagtgggcgaataatgctttcttgtacgtgcgaccaattcgctggcttgtcgccttgtttgataaggaagtcgttgattttcatgtattagatgttcaaactggtcgtgttacaagaggacaccgctttttgtcaaatgaacatgttgaaatttcttctgctgacgattatgtaagtacactcgaatcagcaagtgttgtagttaacgctgaggtacgaaaaaatgcaatccgttctcaactgacggcaattgctaaacaaaacaattggtcattagaattagacactgatgcagcacagaatttgctggaagaagttaataatattgtcgaatggccaacggcatttgctggtacttttgataaaaaatatttggaaattcctgatgaagtattaatcacatcaatgcgcgaacaccaacgtttcttctttgttactaatcatgacgggaaattgttgccacatttcttatcagtacgtaatgggaaccaagagcatttggataatgttattgctggtaatgaaaaagttttggttgctcgtcttgaggatgcagaattcttttacaaagaagaccaaactaaaacaattgctgactacatggaaaaggtcaaaaaactggttttccatgaaaaaattggtactgtttatgaacatatgcaacgaactggcgttttggctcaggcactagcacaatcactgaattttgatgaacaacaattgtctaacgtgagccgtgcagcagaaatctataaattcgacttaatgaccggtatggttggtgagttcgacgaattgcaaggtattatgggtgaacactatgctaaattatttggtgagaatcccgctgtggctacagcaattaaagagcactatatgccgacttcagcaacaggaaaaattgctgagtcagatattggtgctgtactagcagttgccgataagctagacgctattgtaactttctttgcagctgacttaacaccaagtggttcaaatgatccttatggactacgtcgcgcagcaacaggtatcgtaagaacgttacaggaaaaaaactggcatattgctttgaaaccggtattaactcagtttgcccaatcacagggagaagttgctgcggctgatatcacagctgtactggagtttatcttagatcgcgtgcgtaagttaacgttggatgatggtgttcgccaagatttggtatctgcaggagttagtcgctcaggaaatactgacgttgtttacctcatagatcgtattaatgtactcgctgctcatagtaaagataatgatttccgtgatgtgattgaatcactgacacgtgtcgatcgcttagcagtgaagcagttaaccaatgatagcgtggatccatctctatttgaaaatgatgctgaaaaagaattgtatcaggcaacgtatgcactgaacttaagccacttagtaaaagaaggtgctgacgaggtatatacaacattggctgggttacaatctcctatttcaacttattttgaagatacaatggttaacaccgagaatgcagctgttaaaaacaatcgctatgcacaactgaatgtaattcatcgcttaattagtgaattgggtgatttagaacaaattgtcattaagtaaaattattaaataataggtcgtcactagaaagtaggaggtcattatgttgaatattgcttacgttggttttggaaaaagcacaaatcgttatcatttaccttatttaaagttacggcaagataagtttcacgtgagccgtgtagtaacacctacacttgggaaaagaccaacagagcaatctgagttagaagttactggtactgtattttcaacagatattgatgacattattgaagatgaaaccatcgatctagtggttgttgtaacgccttcagccagccattatcaggtgacaaaacaactactgttggctggaaaaaatgttatggttgacaagccaatggctgctagtgatatcgaggctcgtgatttggtcaatattgcttatgataaaaagttatttttgatgccatttcaaagtaggcgatttgatagtgactttttgacagttcaacgggttattcaaaatgggtacctcggtcgtttagttgatcttgaggttcatatggaccattatcgacctaatgacgggcaatcgaatggtaatgaaattgacggatcgctattcggacatggtgttcatttggtagatcaaattgtgagtctctttggtgcaccaaattcagcagcctacgatatacgttctactcgcttactgaatagtcctgtagacgaccaaattgaggttaaccttttttatccacaagcttttaaagcaacaattcaaaccacagaattagcaacaatccaatatccaaaatggcaactgcgtggaacacaaggtacatttattaagtatgaggttgatgagcaggaaaatgaccttaaaactggtgttatgcctggagacgcgcgttttggcgttgacacaccacaaaactatgggcacttggtatactacaatcagagtggtgatcgcattgataaatacatacctagtattcagggtgattatggcagagtctatgattctgtttataacacactggtcaaaggtatgccaaaacttgtttccgatgaaaatatgattactgtaatgaagatactgtctgcagggttgaaagaaaaaggaccgcacgtcgttaaattttcatgaaagttaaaagcttggcaatagcctagcttttttattttgctaaaatagcggtgtcattttcgaaaagtaacgtgaggctttatggtaaaattaaatagatagaaaactgaaagaaaaaaatgccaattatgacagaattaaatttgaatgaacttaaagaacgacaaaaacacatacgtaatttttcaattgttgcacacattgaccatggaaaatcaaccatagctgatcgtatcttggaacagacacatactgttgctgaacgtgacatgcagaatcagttactggatacgatggatttagaacgtgaacgtggaattacgattaaactaaatgcggtcgaagttcattatgacgctaaagacggtgaaacctacattttccatctgattgacacaccaggacacgttgatttctcttatgaggtttcgcgggcattggcagctgctgaaggggctatacttgttgttgatgcttctcaaggcgttgaagcacaaacgttagctaacgtttatttggccctagataatgacttggaaattctacctgtaattaacaaaattgatttaccggcggcggatgccgaaaaggttcgtacggaaattgaggatgttattggcattgatgcttcagaggcagtgttagcgtcagctaaacaaggcattggtattccagaactgctggaaaaaattgttaccgatttacctgcaccgcaaggtgatatcgatgcaccactacgtgctttgatttttgattcagcctacgatgcttatcgtggtgtggttgttaacatgcgtgtacgagaaggcattgtaaagcctggtgacaaggttcgtatgatgaacactggtgcggaatatgaggtcacggaagttggtgtgatgtctccaaatgctcagaaacgtgattacttgatggcgggggatgttggttacttaacagcagctattaaggacattcatacgacacattctggtgatacaattaccctagtgaataatccagccagtgaaccattatccggatatcaaccgatgacacctatggtttattctggtctatatccttcagacaacgctaagtacacggatttacgggaagctttggaaaaactacagctcaatgacgctgcgttaacatttgaaccagaaacttcacaagcactaggatttgggtatcgagttggctttttgggtttgctacacatggatgtcattcaagagcgactagagcgcgagtttgatttggacttggtgacaactgctccgtctgttacttatcgagtggtaactaatgatgaagaaactattgagattgaaaacccatccgaaatgccagacacgcccaaagtgaaatacattgaagagccctatgtgcatgcccaaattatggtgcctaatgattacgttggtgctgttatggaacttgcgcaacgcaaacgtggtgaatttgacacaatggaatatttggatgacacgcgtgtcaatgtcaagtattacatgcctttgtccgaaattattttcaatttctttgataaactaaaatcgagcacacgtggttacgcttcacttgattatgagttatcatcctacagacaatccgacttggtcaaaatagatattctgttaaatagtgagaaggttgatgccctgagtttcattgttcatcgtgactttgctgtagaacgaggacggattattacttctaaactaaaagagatcattccacgtcaaaactttgaaattccagtgcaagcagctattggcgctaaaatattagctcgtacaaacattaaagcttatcgtaaggatgtcacggctaaaattcatacgggtgatcctgatcgtcgtgcgaagttgctcgacaagcagaaaaggggtaaggcacgtatgaagtctgttggttcagtcgaggtaccgcaagaagctttcatggctgtgcttaaaacggaggacgatgcccaatatgcccgaggaaactaacacaaagcgttctagattagcacgcaatttatccgagcagtcaaaaccaacaaatcgtaaagttaaaatcctaacagtttgttcagtactggttatgctgttagtggttagtctgacagttgccagagttgtttttaattttgatggcatctcgcaggagacccgtgtgaaaactcttcaaaaagatgcagcgatcgcgttacaatttggcttgacaggccattctgatgacaaacgcaccaaacaggttgtacatttaaccaatacagcgtggcaaacagaaattgctactagtgttggcaaagcgtggaagagcagcgctaaagtggcagattcagttacttttgatggccataagtatcaaaagaaacaagtcataagcgatttatcgcaacgatatgtaaagaccttacaacgtgatcgtaactataaaatcacaaaaataaggtatgatcgataccataacgcaaaggttcaatataaagtaacacctattgatttgcctgctggccagaaaaaagttcaaagatatgttgaaaaacaattacaaaagaaatctagtgaggcaagcaaattatctgctgaacagttgcgcttagttgagtatgctatgatcgctgaaaactggcaaagtgttttgaaggatgacatgccaacctcagcgacgagaaatatgacaataacaatgttgtatactcatgaaaactttaaaccaatttatcaagtatcgaaacaaacgctgaataatattttaaatagtgggttatcagaatgaatttattagacaaaataaaaaacatttggccatttggtcaaagtcataaaatgcgtgccattggatttgaacggcctctattaattgatcaaccggatgcttttgtggaaaaagttattccccgaccacaaccggataaagatgaattactagttaaagttttggccagctctgtcaatccggtggatacaaaaatgagagccaattatactcatgatggcgtttttcgtattttgggttttgacgctgtcggcgtggttgtagaagttggtcaaaatgttcaacatttcagcgttggtgataaagtttactatgctggagcgcaattgaaacccggttctaacgctgaccttcaagttgttcatgaagcactggtcggccatgcccctacttcattgagtgatgaagaaattgcggctatgccgttaacatcaattacagcctacgaaatcttacatgaagcgttgtgttatgatcttgaggaaaacagtgccttggggcacacaattttgattgtgaatggtgctggtggtgttggatctgtattaattcaattagcaaagtatatcgggatgacagttatcactacagcatctcgcaccgagtctgttacttgggttaagtcacttggcgctgattatatcttagactaccatcaagatttgaacgagcagatgagaaagattcagcacgataaagttgataatattgcgattttacaaaatacggattattattggccacttgcaacagccgttattaagccatttggacgaattgcatcaattgttgaaacgacggagccaattgatatggggcctttgaagaacattggcgcacagtttagctgggtgttcatgtttgcgaagggaaactatggcgttaatatgcagtctcaagggaatgcacttaatcaggtagcgcgtttacttgatgagaataaaatcaagacgacactgtcgaagacttatcacgggctgtctgtagaaaatattcgtgctgctacgaaagaagttgaagctggtcgcatgattggaaaagtagtggtgaagtatgacgaacaataaatggcaggcactcaccgttgcgacgaacaatgatggcattgaaccaattgctgatatattgatgtcaaccggcgctgagggtgtgcagattgttgatgatatttcaccagtaacagtgacagcttattttgaagacgatgcatctttacctaacactgttagtcggataaaagaacagttggataacttagtgacgcttggggttgatgcatcacctgcaactattacattaaatgacgtggcacaatcagattgggaaaacaactggaaacaatattatcatgccacccgcataacaagacacattactgttgtaccttcatgggaaaactttgtagcagctcaaaaagatgaatatccaattattatggatcctaagttagcttttggaacaggagttcatgaaacaacacgattaatgatccaagcgctagaaactgtcgttcgtggcggagaaagcatgatagacgtgggtacgggttcaggagtactatccgtcgctgcaaaacaactcggtgtagcaggtattttagcaacagatattgacgagatggctgtgaatgttgctaaagaaaatttagcgttaaacccagtggccaatgatgttacagtggtaactagtgatttactggagtcaattgctatcgataagcctgtagacttgattgttgctaatattctagctgacgttattgaacgccttattccacagacatggtcacgcctgaagccaggtggctatttcttggtttctggaatctatgatgctatttcagtatcgattgaacaacagctacaacaagcgggatataaaatttttcaacacacaacaatgggtgactggcatgcattcattgcaaaaaaggattttaaataatgcaacgctattttctaaacgaaccaattaatgatacgattcgcttgacagctgacaatgacatttttaagcactttggcaaagttttgagagctcgagtggggtcaaaagctgaatttgttagtaataatttggaaatctgccttggagaagttactttaattgattccgaggttattaatatcaaagtgattgatcgatattattcaaatgttgagttaccaattgatgtaacacttgtcgtgtctcccctaaagaatgatcgttctgactggtttatccaaaaagcaacagagcttggtgtcaaaacaatcgttttcacctcaatgaaacgaacagttgccgattggcgaaagcaacaagaaaagaaagtcaaaagatttaataaaatagcgcaagctgcagcagagcaagcacatcgcttggttgttccagaaattatttttaccacgtggcaaaatactatccaaatgcctaaaaatactggacttgttgcttgggaagaatcagctcgtgatggagaaagtgctgcactaatagcggctgtttcggctgttccatctggagaaaaactagtctgtgtatttggtcctgaaggtggtctaacagaaaatgagattgaggaattacgattgcagaattttgaattagctggattgggtcctcgaatattgagagctgaaacagcgccactctatgcaatgtcagcgattagcgtgttgcgtgaactaaattaattcgttataatataataaataaatgagataactataggtggtgaaataatgctgaagatattcaaaaaatactacgggtatcagtggcttgcagcgtttatgcttggtttggtactaccatttattggtaagttactcagtgtgagtggtttacataaagttatctggttttatctaatcattaatggtctttatactttatatcttgggtatagtgtgcgtaagcgtgggctatcacctctcattttatttgccttgcctgcagtattctctggaatttcaacattattacttcatttggtatctcatcagtatggattttattttggactaatgtacattgtactaagtttattcacctttttcggagatacacgtgatgacccggatgaaaatcaaattccagttgaaaacggattccgtgatttaaaaagtgagacaaagaatgatggacaagtttcagttgatggaaacttgaaagtataattagtgttatgaataactagaaaaagtgcgatatttcgcactttttctgttacactggtataggatattttacctttgtgtttaatagttattgctcaaagcatacagataataatgaactctggagatactattttacattacttaattggaggattttacattgattacagtttcagatatgagttttagtttttcagggcctaaaatttatcaagatgttaacttgaaattaacgcccggtaatacttatggcattattggtgctaatggcgctggtaagtctacctttttgaagttattgcaaggagaactacaaccaactgaaggaaccatttcaatcggtgatagcgagagaatgtcgtctttgcagcaggatcactttgcatttgataaatttacggttttagatacggtgatccaaggtcataagcgattgtacgaagttaaaactgagatggacgctatctatgctaagccggattttaacgatgaagatggtgtacgtgttgctgatttgggtgcggaatttgaagagctagatggttggaatgctgaagttgaagctggtcaattgttgagcaagctgggtattagcgatagtgtttacgataccttgatgggtgagctaactgaaaatgataaagtgaaagttctgcttgcgcaagccttgtttggtaatccagatattttgattttagacgagccaaccaacggattggatgtacagacgattaattggctagaagactttctagctgattttccgaacttagttattgttgtttcccacgatcgacattttttgaacgctgtttcaaccaatattttggatgttgattttggaaaaattacaccctttgttggaaactatgatttttggcgtgaatcgtctgaattggcccaacgcttagcttctcaacaaaatgctaagaaggaagaacaaattaaacagttgcaagatttcgtagctcggttttcagctaatgcttcaaaatcaaagcaggctacagcccgaaaaaagcaattagataaaattactttagatgatattaaaccttcatcaagaaaatacccattcattaatttccccattaatcgtgagctcgggaatgatatggttcgcgttgaaaacgtttcaaaaacaattgacggcgaaaaagtattagataatatttcctttattggtcgaccaaacgataaaattgctattttatcacgttccgatttagcaaccactacgttgatgcaaattatagcaggtacgatggcaccagatgaggggactgtttcttggggtgttacaacgtcacaatcctatattgctaaagatttaaatgataacttcgataatcaagatgtaactattttggattggttacgtgattttgcggaagaagaccaaaaagataacaccagtttacgtggtatgctcgggcaaatgctgttccgtggtgatgattccttaaaacaaattaatgtgttatccggtggcgaaaaagtccgcattgttttggcaaagatgatgttgctcaaagctaatgtgctattgatggacgacccaacaaatcatttggatttggagtcaattcagtcccttaacgatgcggtaatcgcattcaagggttcaattattatgacttcgcatgaccatgaattcttagcaactacggcaaatcatattgttgaagtgtcaccaaagggtgttgttgatcgcgttgatacgacgtatgatgaattcattaataatgatagtattcaggacaaagtaaatgaactttactagtagataagtaatataataaattgaattaatgagctggcacaaaaaccataatttgtaacatattgtgaattttgagcgtcgacttattaattctttttttgctatttaaccacaataaaacaggaggtaaaaagaatggcaattggaattgataaattatcattttacacatctgaatatgtattagatttggtagaattagctcagcaacgtggggtggatccgaataaatatactattggtattggtcaagataaacaatcggtgataccgaattatgaagatgtcgtaacaatgggtgctaacgcggctgcaaaaattattgataatgatgatcgtcagcagattgatttgattatttttgccactgaatctggtatcgataattcaaaatcaagcgcattatatgttcaaaaattacttaatttgtctgaattttcgcgaacaattgagattaaacaagcatgctatgcgggaacattcggattgatgcaggctcgagattacgttgcaagccattctggtaaaagggttttagttatcgcatcggatattgcaagatacggattaaatacacctggtgaagtgacccaaggtggtggagctgttgccatgattgtttcagaaagcccacacattgcaacaattaattctgattcggtttatatgagccgagatgtcgcagatttttggcgtcctatcgatagaacggaagccatagtagacggacatttatcaacagatatttataaagaaatgtttttgacactatggcaacgatataaggaccaatccgggcggacaatcgctgattttgcaggttttacttttcatctaccgtatacaaaaatgggtaaaaaagcttttgatcaaattatagatgaggctgatgagagaacgcaaggacggttattaaaaaatctaaaggcaagtcaaaagtttagtcgagaagtagggaatttgtacactggctctgtgtatttaagcttgttatcattgttgagttacgcacaagatttggttgcaggagagcggttggccatatttagttatggttcaggtgctgaagccgagctgtactctataacattgcaagaaaacttctttaagtatgtaccagcaaatgaaacaaaaaatgaattagctgatcgaaaaaaagtatctgtagatcagtatgaacaaatatttaattcacagcttcttgattcacatgagaacgtttcatctgatcatcctgacgcagatcattttcagtttttaggttggcagaatggtgaaagacaatataaataaaaaatgaagagatgcgtatgcatctcttcattttgtgatagagctgatttcagcaccatcttttgccgcaaacaacactttgttactgtcattgacacccattagttcaaaagtgtatccagttttaaaagattttttgatattcttcgaagtttttaaaagtgaatcagtgaaattcgaccagtgcgcttcttctgctaaacttgggtcggtctctatttgagcaaccgactttgataaatctgaatcagtgtaaagtttgagctggaaagttttggcatcggtattaaaagtgacgtcaccaattttgctatatgctgtgtcaagtttctgagtaagctcttgttcttttaatttgagttgttcttgctgttgtttcgttgtagcatcggatattacagtcgtactgccattttccaaatttgattgtgaatgggcttgttgcgacttggttagtttgtttgaatttacctgtgcgtcattatttttttgtatcttttgtattgctgacggcaattgaaaaccaaaaaagattgtaccaccaatacataatattgagaatataagtggtactagaaatgtcccatatctctgcttattttgtatcgtaaaacttacaagtaatatgcttaataaaaataaaatgataaacaaaaatatcattctcttatcccccttattttgaaaaagaaaaagcacttaaccgatgaagcgtgtcccggcacggcatcaccattatagttaagcgcttgcaacattattatatctaaaattattgtctgtttcaagtataaaagaactactaagaagtcatttgtttatttgttttgcgaaacgttattcatttagaagtctttatgtcttcaggtcgattaatctcaccagaaggtgtgttatactaatagcattaaataatattggagttaaaaatgtcaaaaaatgtttaccttgcgagtccattcttcgataaagagcaaattgagcgtgttgaacgtgttgaaaaagctttagcagccaatcaaacattaagttctgttttttcaccacgcgaacaccaacacgaagaatttgaaatgtttggcccggagtggcgtgtcgcaacctacaacggcgatattgaggcaattaaccaagctgacgtcatggtagcggttattgattatgtagggcaggaagtagatccaggaactgcttgggagtttggctacgcagtagccaaaaacattccggttattgttgttaaagaaaaagctggtgcagtaaatctaatgatgggaatgccattaacggcttatattacggatatctcagatttggaaacttacgactttgatgctacgccaaagattgaatttagtggtgaaatcttttaatttttaagagtgaacttgatatgtgtctcccgaacaaaataaaaaacaggtaatcatttgaacgtatattttttgttaatcgttttgaatggtgatgtaattgtataatgaatagatgataaaacgaataaaaaatagtttgtactattaattattcgtttttgcgagatagtttgctgtataatctggtataatattgtaagtaaattttaatggagaatttgtatgactatgagtaaagcagttgtaacagttgttggtaaagataagccgggaattattgctggggtggctaacacgttagcggatcacaacatcaacattttagatgtttctcaaacgattatgagtgatattttcacgatgagtatgctaattaatttagaagaattagaagggcaatttaacgtgttgcaagatgatttgaataagttagggactgatttaggcgttactattcatacgcaacgtgaagaaatatttgatgcgatgagtagagtttaatatttgtagctaacctactaaagaacttacgaattgaatcatctggagaagtcatggaaacaaagcaaatacaagaaacaatcaacatggtcgaggaagaacatcttgatatccgcacagttacaatgggtatttcgttgctcgacacaatcgcaggtgatccacaacaaactgcaaaaaatatatataagaaagttacaacatatgcgaaggacttgataaaagttgctgagcaaattgaacgtgaatatggtattccaattacaaacaaacgcatcagtgtaacgccaattgcgttgattgcaggtcatgcaacacccgatgatatgctttattatgcacacgctttggatgatgcggctaaagcagtgggtgttgatttcattggtggttattcagcattggtccaaaaaggttttgccaatggggatttggcattaattaaatcgttacctcgtgcgctaacagaaaccgatttagtgatgtcgagtgttaatattggttcaactaaagcaggtataaaccttgatgcaattaaattgatgggcgaaactgtaaaaggaatttctgaaaaatccgatacagctaatgccaagctcgttatttttgcaaatgctgtcgaagataatcctttcatggctggtgcttttcatggtgtcagtgaagccgatgttgtgattaacgttggtgtttctgggcctggcgttgtaaaacgtgcactggaaaaggtaaaaggcgaatctattcaagtagttgccgaaactgtcaaaaagacagctttcaaaattacacgtgttggacagatggtgggtgcactagctgctgaacgacttggagttgaatttggaattgtcgatttgagtttggcccctacacctgcacgaggtgattctgtagctgaagttcttgaagaaattggtcttgaacaagtaggaacgcacggaactacagctgcattaatgctattgaatgacgctgttaaaaagggtggtgttatggcttcgcaacgtgttggcggcctatccggtgcatttattccagtttcagaggatgctggtatgattgatgcagcaaaagaaggtacattgacgttatcaaagcttgaagcaatgactgctgtttgttcggttggattagatatgattgctattccaggagatactagtgcaacgacaattagtgcaatgatcgctgatgaagccgctattggtgtacaaaataataaaactacggctgtccgtattttgccaactttgggtacaaaggttggtgatatggttgattatggtgggttgttaggtactgctccagttatgccagttgtagaaaagtcaagtgcagactttatcaatcgtggcggacacattccagcaccgattcattcatttaaaaactaataaaaagttgcgataaaaatcatcgcaacttttttattttgtatttttcgattgttgtgttcgtgtttcggtaattggattttggtttgtggaaactgctttagaaaacataaccgcaatataaactaatagaatcagaataacgacggtagataaaacacgaagtgggtgatagaaaaagtttttaatataatttgaaatggcaaaatgttttttttgcggtgcagcactttctgtaattgaggcttccaaggcataggcaaaactattagtgtcaacagctctggctgttgattcataaggaacaatagaaatttcacgtgtttttgataacttagctattcgtttgcgtcggtcatctcgattttttaagacattttttcggaaattagcaatattaaccaatgccttgttttgtaacttcattacgcgctcacgtaattgctctatggggctatatactggtactttcatatttaatctccatatctttaacgttaattgttagatcctaactttactatacgacatcttaagacaaatttgggtgagtttatatgattgcaaacaaatttaattgttcttaatcttttcaatagatagtataatgaaaatatgacaacacgtgaagaacaactttatcatgattatttagaatcagaacgccaatattcaccgcaaaccttaaaagcttatttaacagatattgctgaatttaagaattatttgcatgaaagtggcggatttacaaaatttggagaagttcaaactttagatgtacgtgtctatttgaatgatttatatgaaaaaaagttggctcgtacaactatctctagaaagattagcagtttgcgaatgttttatcaatttttaattactaatcaatttgccattgataatccatttgatagtatttcattaaaaaaacatcagaaccaattaccagattttttttacgaagatgaactgcatgaactttttgatgtggcctacaatcatgaagatcatttgtgggaacgtaatgcagccttacttgaatttttatatgctactggcataagagtggctgaaattgctggattgacgctatctcagttggatttttcgcagcgcctggtgctcattcatggtaagggaaataaagatcgttatgttccttttgggcattttgcagaaaatattatgaaagaatacattacagacttgcgtgcatccttaacagtaaatcaagaacatgaatatgtatttgtaaatcatcgtggcgagccaattacaccagctggcattacctacattttaaaccagttaatgcaacgttctgcattgactggtaaaattcacccacatatgttgcgtcatacttttgcgacccatttgattaatcgaggtgcagatatgagaacggttcaggaactgttgggtcatgttaatttgtcaacgacacaaatgtatacccatgtgacgcgagaaagtttacaaaaaaattatcaaaatttctttccgcgagccaataagtaaccggttacaaaaatagtttatcaagcgcttcacaaatctaagaaaagatagtaaaataaaagttatgataacgctagaaaataaacacctcattgtgaaaattaatccagaaggcgccgaattaacaagtgtctggcataaaaatgctgaattagaatatatatggactgcagaccctaaatattggggacgacatgcttcaaatctgttccctattgtgggccgattacgtggcgatcaatttagagttgcgggtgagacgtattacatgaaccaacatggttttgcacgtaatatgttatttgatgttgttgaacaaagtgaaaataaggctgtttttcgtattgttgactctgagtcgacgcatcgtgtatatccttttaagtttcaattagatatcagttatgaattaacagaggatgacacactacatattgcttatatcgtacataatcccgataaagaagaaaccctattctttagtgtgggtggacacccggcctttaatttgccactggatggaggaaagttttcggactactatctgtcaattgagcctgaaaaaatatatgatcgtgtacgtctagttggaccatattccaatccaaaccatcccacgccttttaatgctagtattccactacgtctgcgtcaagaagactatcatgatgatgctattattttgaaactcaatcgacaaaagacgtcatttttgttggctcgtttggctaatcaacatggattgcgtatgacgttagacaatgcgcaatttatcggcgtttggacacctgctggtaaacaagcaccatttattgcgcttgaaccatggtgggggttggctgacacggtggatgcaacaggtaactttaaagagaaatttggttcaaatgttttagctgccggcgacacttttaatggcacctatagtctacagttcttctaataagaaatcattgatacattagtattgatgacttttttattagaatttaggttaaaaggttgcattatctatcataatgtcttaaactgatagtaatttaaaaacgtcataaactgatgagacggagatcaaaccatgtgtgcacgtaaagggagcccttgttactggaagtagggccgaacgcaacatggcaaatggaccgttgagggttggttgaacgagagcaatctcaagtactgccaaacgtaagatccacgtaagtgatcaggttattgttagataactgttgagacgcgttttaactcgagtgggctttttgggtaccatttgatttaaacgaaatcaggtggcaccgcgggaaaaccgtcctgaaatttttgcaaaagcaaatttttcaggacggtttttgtttgcttaaagaaagaggaataagatgacaagaaaaggttattacggagaatatgggggacaatttgttccagaattgctaatgccagcaattaatgaagtcacagaggcattcaataaatataaagaggatccagcttttaaaagtgaattgaaagatttattcgacaattacgcgaaccgaccatctatgttatattatgcaaaaaatatgtctgaagacttaggtggtgcgcaaatttatctaaagagagaagatttaaatcacactggtgctcataaaattaacaatgttttagggcaagcattaattgccaaaaaaatgggtaaaacacgtttaattgctgaaacaggtgccggacaacatggcgtggcaacagctacggctgcggcattgtttggtatggaagcagaaatttttatgggcaaggaggatacagaacgacaggcgttgaatgtttatcgcatggagctactaggggccaaagttcatgcggtgacaacaggaacacaagtcttaaaagatgcagtgaacgcaacatttcaagactggacaaaaagaattgatgatactttctatgtacttggttcagcggttggtccatatcccttcccagaaatggttaaatatttccaatcggttataagtgaggaagccagaaggcaattcttagaaatgactggaaaactgccagacgctgtaattgccgccgttggtggtggatcgaatgcaattggtgctttcgctaagttcattgatgacgcagaagtggaattgattggcgttgaagccgctggaaaaggcgtaaaaactgatcaaacagctgcaaccatggcactaggttcaaaaggtgtttttcatggtatgaaatcccaatttttacaatcagccgatgggcaaattgatcctgtttacagtatttctgcaggattggactatcctggcatcggaccggagcatgtttatctaaaggatattcaccgagcaacttatgtaccgattacagatgatgaagcagttgatgcatttgaatacattgcaaaaacagagggtgtaattgctgcaattgaaagcgcacacgcagtagcctatgcaatgaaattagcaccaaaaatgagaaaagatcaacaaataatggttaatctgagtggtcgaggtgacaaagacgttgctgcgatagcccgttataaaggagttgatattcatgagtaatattcaagaagcacttaaaaccttgctcgtgcaaaaaaatttgacagatgatatggctcagaaagtaatgaacgatattatggacggcaaagtgtctgaccctgaaattgcagcttacttaatgggattagccgcaaaaaaagaagctgtttcggaaatagttggctcggctcgggccatgattgatcatgcaaagacaattccatcagaatttgaggcaatggacattgtcggaactggtggtgatttgtccggtacattcaacatttcgacaacggctagtttcattgtagctggagcgggggtgcctgtcgtcaagcatgggaatcgtgctgctagttctaaatcaggtacggcagatgcattggaagcacttggggttaccattgatttaacaccagaacaagcgactgatgttttagcgaatgctgggcaaacatttttatttgcacgctcgtttaatccggcaatgaagtatgttggatcaattcgtaaaagcctgggatttcgtactatttttaatatccttgggccattaacgaatccaacacgtccacgtacaatgttggtgggggtttacacaaaagagttactagtaccactagcaaatgtattgtcagaattaggtgttcaagaagctatattggttcatggacaagatggtttagatgaggtgacattaacaactaaaactgatttggccatattatcgaatggtcatattagagaggccactttcgacccacaagattatggatttgactatgcttctattgaatccttacaaggggggacaccaattgaaaatgctaaaataacagagcatattttagcaggtaaaatcactggtcctatggcagatactgcaattttaaatgctgcgctagcattgtttattgcaaaaaaagcgcagtccattgatgctgccattcagctagctagagaaaccttgattaatggaacggcattaggtcaactagaggcgttgcgatcatcttctagggcggtgacggcatgatattagatgatttagtagcagcaacacgtcaaaatatgttggcgcgtcaagctcaaaaatcgctgcatgacttacaaaatgaagcagcacacatcacagtttcaagagaatttcctttcgaaaaaagtctagctcaacaaaaaatatcagttgttgccgaaattaaacaagcatccccatcgaaagggcaaattgtaccttcatcagagtttgattatcaagggatcgcgaaagactatgaggtggcaggtgtcgatgcgataagcgttttgacagaagagaattatttcaagggatctcttgatattttaaaaacagttgcagcagattctgctactcctgtattacgcaaagattttacaattgatccatacatgatttatgaggctaaagtagctggatcacaaatcattttattaatcgttgctattttaacggacgaacaattaaaagaatacctatctttagcaaacgaattaggattgtcagtaattgtggaagcgcacaatgaagaagagattctccgagcagtgaaggcaaatgcacgaattattggtgtgaacaatcgcaatttaaaggacttcacggtcgattttgataacaccaagcgtttacgacaattagttccaccagaaattttatttatttcagaatctggtataaaagatcgctcagatgttgttactcttgaacagattggcgtggacggtattttagttggtgagacgttcatgaaggctgcagataaactagcggccatacaacagttaaggggcgaaaaatgacgctaattaagttatgtggaaattttcgtttacaagatatagatttcttgaatgatgttcgacctgatttagttggtattatcttggttcctaacaaacgacgctcggtgtctcttgcccttgctcaaaaaatgcgttcgcaattggatgaaaagattccattagttggtgttttcttaaatcaagatgcagatgaaattttgaagtatagagagattgttcaaatggttcaattgcatggcaatgagtctgaacgggaaattagtaaaattcaacaagcgggattaccagttattaaggtgatgaagcctgaccatcagtataaaacgcaagctatgtgccggatgattgacgcaggagcaggaaccggaaaaacttttgattgggaaaattttcagccactagagtcattggatttcttggcaggagggctgacacccgataatttacaacaggcaatctctttattgaaaccaaaggttgttgatattagttcaggaacagaatgtaatggtataaaaaacttagaaaagatgcgcgaagtggttcgcatagcaaggagtaataaatgactagaatttcacaggcattagaaaataaaaatgcttttattggtttcgcggtagctggatatccggattttgaaaagagtgcaaaatatattgttgatatggctgaggctggtgcagatcttattgagattggcattgcttttagtgatccaagtgctgacggtcccactatcatgaatgctgatcaagaggttctcgaaaacggttcaacaacagctgatgtgtttaatttagttgctgaagttcgcaaacacacggatgtgcctttagtttttctaacgtatacaaatccagtatttaaatatgggtacgaaaaatttctcagcaaaatgcagtcgttggatattcagggtgttattatgcccgacatgcctatggaagaacaagatgaatttttggaacttgtccaccagtatggtcgcgactttattcaactcgtaacattacaatccggaaatcgtttgccgaaaattgtagaacgtgcttctggatttatatatgtagtaagttccttaggaatcacaggctctagaagtaaattgtcaaacgaagctgatgaaatcgttactaagattaagcggctaacagatttgccagttgcagttggttttggcatcacgacatatgatcaagcaaaacaatttgaatctgctgatgcgattattgttggctcagcacttgtcaaaattatcgaagaccacccagaggatgctacatcttatttgacagattttattaaaaacatgaaaggagcgcgtcatgcgaaaaattaagacaattgacgcggataccttaacagtaatcagtgcttattttcggttgcgcggagaacatagttttttattagaatcagtacctacagatagtgaaaagtcacgttattcaattatcgcacttgatcctgtccatgagtttaagaccaacggtatgttggtgacggttgatggtcaaactagtgaaagcaaagatcccctgctggcattgcaaaatttagtagttgtgcaagaacagcccgtggaggagttgccttttcaaggaggtgccattggatatgtagggtttgatacggttgcttgctatgaaaaactagaaaaccaacctaaagatgagttggatatgcccgacagccatttatttttgtatgaaaattttgttattttcgaccatcgtcaagaaaaaataaaaattgtcgtggataatgtttattcgggacgtcagaacttagaacacgtcgttcttgcaatcgaaaataagttgaaattacccgtggctgatgaactcgttccggtaaaactacatgaattaaatccaaaatcaaatgtgacgcccgagcaatttaaagaaatcgttaatcatacgaaggaattaattcaagaaggcgatatgtttcaaatggttccgtcgcaacgttttagttttgaatttgaggataaaccgtttgatttttatcggcaacttcgtcgtacaaatccttcgccgtatatgtactatatggactacggtgattatcaaattattggttcatccccggaaagcttggtgacagtaagaggagaaacagtaactactaatccaattgcgggaacgcgtaaacgggggcaaacattaacagaagacgttgccattgctaaagagttgaaaacaaatgaaaaagaactagcagaacaccgtatgttagtcgatcttggacggaatgatcttggtaaagtttctgaatatggcagtgtcaaggtaacaactttgctggaaattcaaaaataccgttatattatgcatttggtttctgaagtcagtggaaaattaagggcacacacacctgctattgaagctttgaaagctacattaccagctggaactgtttctggggcacccaaggttcgtgctctgcaacgtatttacgaaatggaaccagttaaaagaggtgtttatgccggtgcaattggttatttatctcgcgataatcagatggattttgccattgcgattcgaacgatggttgttaaaagtaaaaaaggatatgtacaagcgggtgctggtattgtctatgattctatagcagaaaatgaataccaagaaacgcttaacaaggctaaagcgttgttgcgagttggaggggatgtatgattttaatcgtggataattatgattcttttacttataatctagcacaaattgtaggtacaaagactgatttagtggttttaagaaacgatgatcagaaactctatgcgactgctgataaagctgacgggattattttttcgcctggcccaggaaaacctgagcaagcaggagaaatggaaaatatgattcgacactatgccaacagcaagccgatgttgggcatctgtttagggcaccaagccattggtgaagtttttggtgggcgtgttaaacgggcagctgttattcgtcatggtaaggtttctgatatgctggtagcagacacatcgccgttactaagcacaggattagtcaaaattatgcgctatcattctctcattcttgataaaaaaaattttccaaaagatttcaaagtggttggcatcgcacaagatgacgatgaaataatggctatgcaacataaaactttaccagtgttcggctttcaatttcatcctgaatctattggaacgccgacaggatcaaaaatgattgaaaaatttatagcgctaactgcaaacgtaaaataaaaactataataatgaaatctagtgcaagaataaaagcttttttcatgaggaattaatgatgtaatgaagtttattttaataaactgttgacatttataataaatgaatgtatagttaattacatcaaataagaatgagaaaaattatgaacagcaaagtcttgaaaaataatagttattactacttctggtttatgtagagccgtcgcattataagtgcgtcggttacgacgcacttagcgaccaggagtttttcaaggttgagtcactaagtgttgatattaaacacctagtggcttttatgttttcaggagtgtaattttctgttaaatcgtactaggtgtttactcacttagtacgatttttatttaaggagaatctcatgaaaacatcatcattgtcaacagaaacaattcagtcgttgaggttgctgtctaaccaaatgattagcaaagctggttctgggcaccctggcattgctttgggtgctgcaccaattttgtatgagttgtatgcaaatcaacttaatgttgatcccgagaatcctaatatgattaatcgcgatcgtttcgttttgtctgctggtcacggtgccgcattactgtatgcgactttacatgcagctggctttgacctgtcagcccaagatttatcagaatttcgacaaccacattcaaaaacgcctggacatccagaagttggtgtgacgcctggtgttgaagcaacaactggaccacttgggcaaggattgggtatggctgttggtatggcaatggctgaagcaaagctcaataatcaatttccctcagtgattgaccattttacatttgcgctagttggtgatggggatttaatggagggggtgagccatgaagtagcgtcactcgctggtcaacaaaagctcggtaagttggttgttctttatgatgataatgctgtcagtcttgatggtttgaagaaaaggtcagatatatcaaataatctagcgcgctttgccagttatggttgggatatacgtgaggtggcagatggtaatgatttagaagccattcacgatgcaattgaaaatgctaaaatgtctcctgagcccacgttgattgctgtgaaaacaattattggtgattttggaccgttcgctggcactaacaaggctcacggcacaccactagacagtcaacaattgcaagatctttcatcagcgcttgatgttgatatacaaaattttgaattaccaagtcatttgcttgaagacatgcgtgctaaaatttcgaatagacttttgcatcaaaaacaacctttgaatgacgaattaaccgattatctgcaattctcaactaaaaacacggtgaccatccccgagttaccgactgatttgaaagtacaagcaggccgaaaaatatctaaatatgtgttgcaaaactttgcgacacaattaccacaattatggggtggatcagctgacttggtagcatctactaatgctgaagtggcgacttcaccattattcaacgccgatgatcgatcgggtagaaatattgcgtttggtgtgcgtgagtttggcatgggcgcggtaatgaatgggatagctttacacggtggtacaaaagtatttggcgcgacattcttggctttttcggattatatgaaggcagctattcgtttgagtgccttgcagcatgtgccgagtatttatgtttttacgcatgacagtattacggttggcgaagatggaccaacacatcaaccggttgaacaactgatggggcttcgtctgattccgggtgttgatgtattgcgtccagggacagccgaagagatagccagcgcttggcagcgggcgttgacgtcaactgatcgaccaacaatcttaattttaagtcgtggcgaaattggtgctcaaggaagcacagaccaagcaaaacaatcacttgaaaatggcgcggcacaaataagacatcatgatgaggctaaaattaacttgattgctactggatccgaagttcaaatagcacagaaggtgagtgaattactgtcactaccttcaaacgttgtttccatgccaaatctgtcgcgattcttagcgctagatgatgataaaaagcaacaaattattcccgaaacgggcacaaaaaatgtgataatagaggcaggaacaacattgggttggcaaggaattgctggcaatgatggcgtaatatttggtattgatgaatttggtatgagtgcggcagcacaaatagctcttgacgaatttggatttaatgctgaagatatcgtcgataaaatcacacaggagttacaatgactttatatggattaatcgcgcatccggccggacattcacgttcgccgcaaatgcaaaacatgatgatagctgaatatggtattgatgcacactatcacgctttcgacattttaccagaaaaacttgaagaggccatcgttggattaaaagccctacacgtaggcggattcaatgtttcaacaccgtttaaaaatgaaattattcaatatttggatgagctatcgccaatatctcagaggcttcatgcggtgaatacggttaaaagtgttaaagggcatctgattggcactaacacagatggagacgggttctggcaaagtattaattctcgccaacccaaagaaacggttattttactgggtactggcggagcagctagatcagtgattgccactgcgaaactgtatggcgtgagggaattaattgtgtttaatagagttcatgaagattggcatgagcgaaaagcagagattagctatcttagtgaggggaatgggcatctagaggatttagcagataatcagatgctcaccaaagcattaaagcgtgctgatatgcttatcaatgccaccaccgttgggatgaatgatttgcggacgctattaacggatttgcaaatagcattactaccacagcacgccttggtggtggacatgatttatcgtaatcaacaaactacattattgaaatctgctaaccaacgtggattagcaacattaaatggtttgccgatgttagtcaatcaaggagcgctgagctttgaatattggttcgacaggccagctgacagaaatcttatgaagaaagcaattgaggaataaaacaatgattattatcgcaaagacaagtcaagatgcagaaaaaattgcagcgcaattagataccaaagaccctattaaaccagtgtttgttcacagtaatagagttgcgttatccggcgtgaaaaagttacctgaagatatattgaaaaatatatcacaagacgttgttgaaataatcacaaaccatcattcagccatcaagtcatcacgtgacttccacccagaggatacaattattacaactaaacatagtgtcatcggtggtggtaacttcgtcttcatggctggccctgattcaatcgaatctcccgaacatgttaaagaaatgggtgaagatgttaagcaggcgggcgcaactatcttgcgcggcggggctttcaagccacgtacatccccatattcatttcaaggtaatggcgaagaaggtttaaaagcccatcgcgcagcagcagatgcgttgggaatggatatggtaaccgaaatcttagatacacgagatgttgatttagttgattcttacacagatattttccaagtcggtacgcgtaatatgcaaaactttgctttgctcaaggccctgggaaagaagaacaagcccgtggttttgaaacgtggtatgtcagcaaccatcgatgatttgcttaatgctgctgaatacattgctgctggtgggaatgatcagattattttgatggaacgtggtattcgtacttatgataataagtacacgcgtaatacgcttgatgtatcagccattcctgttttacaatcgctaactcactatcctgttgttgcggatgcttcacatgcggctggtgtttcaaagtttgttgaaccgcttgctttagctgcaattgctgctggtgcacaaggtttgatgaccgaaatacatgataatccgtcacatgcatttgttgatggtgcccaagcattgacaccagcacaattcaaacaattgacagagaaggcaaacaaggtgcgcgaggccattaaatgagcacaattacagttgatttagcgacaaaaaagtatgatgtgaaaattgataacactttacacacacgtcttggccaagaaatatcggctgtgtggtctgcgcgaaagattgcactattaacagatagcaacgttgggccattgtatttaaaggatacagcaaagcaattacgtgaagtaggatttgatatactcgagttagaagttcccgctggagagtcatcaaaatctttgtcagtggccggtgaattgattgctaaaatggcagctgctggatttacgcgtggcgatggtgttattgcattaggtggtggcgttattggtgatttaggtggagtagtcgcctctttgtacatgcgcggaattgcttttattcaaattgcgacgtcattaacagctcaagttgattcgtcggttggtggtaagacagccgtgaatcttggtaatacaaaaaatattgctggctctttttatcagccggatttagatttagttgatgttacttatttgaatacactgacggaccgtgatttagttgaaggatatgcggaagttgttaaaacatcagcattggctaatcaagacttttttgattttactggtcaaatcaaatcggtagcagatatacgtcatcatgcgcaagaattgtcaaaacgcgcgattgcttataaggctagtgtagtgatggctgatgaaaaagaagctggagaccgccagtttctgaattttgggcatacttttggtcacgcgattgaactattagctcatggtgaattacgtcatggtgaagctgtggcgattggtatgattgctattagcagtcgatttgaacaacatggtataatgcctagagggctaactactgaattattaagtcgattggaagctgttggtttaccaacacattcgcattttatcgggacaactgacttctttaaccacttgatcaatgataaaaaaaatcatgatggtgttttgaatttagtggctcttgaaaaagtaggtcagccaattattgtaaagaaaaaaatcgccgacatgccggcatttgtggagaattaatatgagatatgttactgctggtgaaagccatggccctgaagaaattgctgttattgaaggtattcctgccggattacacatcagtcaagaagatgttaatgagcaattagctcgacgtcagcgtggttatggtcgtggtgaacgtcaaaaaatcgaaactgatacagttacctttttgacaggtgttcgtcaccaaacaacacttggatcaccaattacattgaatgttcacaacgatgatcataataattggtcgaaaattatggcccctaatgagccagcaacagcagaaaatacgctccgtaaggtgttgcgcccgcgtccaggacatgctgatttggttggtgggatgaagtatcgtcaccgtgaagatttacgcaatgttttggaaagatcttcggctcgtgaaacgacaatgcgtgttgcagttggtgctgttgccaaaaaattactttccgaaataggtgttgatgttcatggtttcgttgttaatgttggacctgctaagtccgacctaaatgagttaactaagtataagaacctgcaagagttgcgtgttgtgacagaaggttttgacacacgtgctctaaatgctgaagctgatgaagctattaaagaagtaattgataaaacaaagcgtgatgcaaatactgtaggaggccaagtccaagttattgcgacaggtatgcctgttggattgggttcatatgtatctgccgatacaaagttagacgctaaaattgccaacgctattgttggcatcaatgccttcaaaggtgttcaatttggtggtggttttgataacgcagaaaagtatggcgatcaagtcatggatgaaattttttgggacgaagaacgtggcttttatcgtggttctgataatctcggtggttttgaaggtggtatgacgacaggagaagcaattgttgttcgtggtgttgttaagcctattcctactttgtatcgtcctatgcagtcagttgacattgatacacacgaagaccaccgtgcatcgatagaacgctcagatacaactgcagttactgccgctgctgtaattgctgaggcaatggtagcaattgagttagctaaagctgttttggataaatttgatgcagataacattgaacggatgaaagaacaagtggcagtgtatcgtgaagaaataagaaagttttaatatagcttcggctatagtacatattatgaacaaaggataaaaagagatgattaaactcactaaagcagaaaaaaatggccttcatggagaaataacagttcctggcgacaagtcaatatcacatcgagcattgatgtttggtgcgatagctgaagggaaaactgtcattgataattttttgatgtcagatgatgtgatgcataccatgggtgtttttcgtgcgcttggtgtggaaattgaccacacagaatcacaagctaaagttattggtaaaggccttacaaattttaaggcaccatctgctggattagatatgggcaattcaggaacttcaactcgtctcctcatgggattgctaagtaagcaaccgtttgatctaaatatttttggtgattcatcactgagcaagcgaccattgcgtcgtgttgccgacccgttgtcaatgatgaatgcgcaatttgaattatctaatgacgagttcttaccagctgtaattaaggccaatactggactaaatggtattacttatcatatgccggtagcatcagcgcaggtcaaaagtgctattttactagcgggcatacaagctgagggtgaaacaacgattatcgaagatctaccatcaagagatcatacagagcgcatgctccgtcagtttggtgggcaaattaaaacagataacggtgtaattactgttaaaaagcagtcaaaactaagcggtcagcatgttttagtaccatcggatatctcaagtgctgcatttttcatggtggctggtttaattacaccaaactcggaaattaccattaaaaaggtcggtgtcaatccaacgcgtgatggtgtgattaaattgcttgaacggatgggtgcagaaattactcagaaaccgattgcatctgatggagaaccgttggctgatatcacggtcaaagcacaaactttacacggtattgcaattactgctgaggatattcctggtgcagttgatgaactgcccattcttgctctagctgctacacaagctgtgggagacacgattataagtggtgcagaggaattacgtgtaaaagaaactgacagaatttcgacagtcattagtgagctaactaaattgggcgctgatattgatgagaagccagatggtatggttattcatggtggaacgctcttgcacacgtcaaatggctcaacactacttgactcacatggggatcatcgcattggtatgatgaacgtgattgcttctctcattactgaaggggatgtagtattaaccggtgaagaagctatgagtgtgtcgtatcctggatttgtagaagatgtgtcctcaattaagagagaatggttatgaaaaatatcgttgttgtgggtcttggcgaaatgggggcatcgttagccaaaattttaaacaaagagccaaaaaaccaagtaataggtgttgatattaatgaaaagtcgctcagctatgcaaaagatcatggtattgtttttgaggcagcttctaatttagtaaatgttgcatctcatgctgatgttattatcttggccacaccagtaacttatatcgaagaaatgattcgttcattatctcaactatctctaaaaaaagaggtaatcgttacggatacaggatcgacaaaacgagatattatggatgtggctgaagcagttttgacaccaaaaaatattcatttcgttggtgggcatgctatggccggtactcatcggagcggtgttgagtgggcaaatgaaaaactgtatcaagatgtgccttatttcttaattccaagttcaatttctaatgctcgtaggttgcaggaaattcttgaaccgattgccgctaaatttatgccaatttcagtcaagaaacacgatgagctgatggctgtaattagtgatataccgcatattatgtcttttgcattaatgaatactgccactaaccagctgggcgattcaacgacatttggacagtatgttgctggtggcttcaaagatatgacacgcatagcggaaagtgatccaaagttatggactgatgtattgttaagcaacaaagaagcaatattaactagtcagtccttgataatcgagcaattacaattattttctcaagcaattgaagataatgatgcatcaactttgatgactttaatttcgtcagcacaggagtcaagaaaaaatttattgttaaagtgagaaaattatgattaaagaaccagatacattaatgcttattgggtttatgggtgctgggaaaacgactgtgggtaaggaaattgctcggcaacatcattcaaagttcgtagatattgattctgaaattgaacgtgctgccggtaaatcaatcgcagaaatttttgaagaacgtggcgaagccggcttccgtgagttagaaaccaaagttttaaataatgtgcaaacatttgatggtgttgttgccacgggcgggggtgtagtggaacgaccagaaaacttagaaattctgcgccattctccagcgacaattatttatttacatggcaatttagaaagtactattggccgcttaattcttgaaggacagcgcccgttacttcaagaaaaatcgacggcggaattctttgcattatggcaggaacgtgacccaaagtacgaagaagttgccaatttcaccgtagaaacagttggtaaaacaccggcgcgtattgcagctgagattattgccttatttagcgctaatgaggatgaactagcactactacaattgcgttcacagatagatgcatttgatcgtcaaatttttaaaattatttcggaacgttttcagattgttgaagcagtggctcgttataaagaaaaatttggtataccaacgattcaacaggatcgtatgttaaagttacgtaaggaattgaaatcagattttagtacttctgtagatatcacagatgacatgattgatggtattatgaccattttgatgcaggctgccattgacaaagagaataggcaattaaataggtgatttatgaaacttcacacattaggaccaagtggcacagattctgaacaggcagcacaatattatttaacggacgaaaccctaattttgcacaatagttttgaagaagttttattacatctaagtgactataaaggggataaaataattttaccagttgcatttaagtctaatcaggaaccagatttgaattgggccgactttaattatttaaattggtcacagcttgcaattgaacaaacattttcgctacccttaatgacgatgagtgtgattgaaaatacccaatttgagcgaaatgtagcaatagtccatgcggccacagaaggcttaatgaaaagatatttaacctctgtgaatttagataatgcttgggggccgtcagtgatgtttgcaccaagtaaaattgttgcattacagagctttataaaagaacaaaatcggtttacaattgtttctgaagaacaattcaaaaaattacctgaaagtagtgacggaaaataccaaattaggcaacaattaaagcctcagatggtttggatcgtctatagagtcctatgacattaagagaactattaaacatacctagcagtacgaataaaccgattatagcagtccccctaactttaggacctacggacaaaattagtccgttcgctcaaaaactacaacaacaaaatccagacattgttgaatggcgggcagattacatcgcagatgactttagtcaggcggttatgtggcaacaagttaaggatggggcacaaagtgaattggcgcaaaaagacgtttctgccatgacagaagcgaaaatgttgtcagaaattgataatgccaagcaagaattcatggctaattggccacaaataaatgttcaaattattaaagagttaactggtacggtgtttaatagtattggtggttttccggtgttgttaacatatcgtacggttacacaaggtggccgtggtgaaatgggcccaaccgagtatgccacttttatgattactgctttacactcggggtttccgtttgcagctgttgatgttgaatatacattagatgagccgctacgacaaagtattatggacgcagcgaataaagccaatgttccagtattactgtcataccacgattttgaatctacccctaaaaatttgccagctttaatcagtgatatggctgatacttcagcagatattatcaaattggctgtcatgcctgaatccgaaaaagacgttgattacctattgcaaacaactaagaacgtcaatatttcgcaaccattaatcacgatgagcatgggagagataggtaaacgtagccgtatcgagggatatgaatatgggtcagaaatgacctttgcagtacttgatggtacacaaggaagtgctcctgggcagctgacaattaatgaattattgcaagcttggcaataatgtgttatattagttaagaccaactgggtagtatctatctacctacccgctatctctccggaggtagcgttttttgtttactttgatttactaggcaattatttcttgtgtttacaaaaaataaatgttatagtatttatgaaattatatatgtatgtctggggtgcccgcgagggctgagaaatacccattgaacctgatcggattaaaatctgcgtaggaagatgtgattaatagattttttattaagctgtttttttgcgtacccatttgcgcaaaaaaacagcttttttatttgaaaaatttaaaaaggttcagtgtattgaaaaatttcaaaaatatattatcaggaggtttacgaaaaggagcccatggatgtaaatataactaaggtgctaaagctatatttagtcacaaatcgatacgattattctgatgaagagtttttaggtcgaattgaaaaagcatgtcagaacggtgtcacactcgttcagctaagagaaaaggaggttaccacgcataagtattttgaactggcaacgaaagtgaaagaaattactgacagattcagaattccattgattattgatgacagaatagatatctgtcaagcagttgatgctgctggtgtccatattggcgataatgacttaccgatatcagtcgcaagacgtttaattggtccagaaaaaattttgggtgtgtctgctaaaagtgtcatgagagccacacaggccgaactagagggggcagattatttaggagttggcgctatttatccaactaagaccaaggtaatcacaaaacctacgtcaatcgaaactttaaaggagattacacgaactgtctccataccagtcattgcaattggtggtatcaaggaacatacaattcacaactttaaaaatactgaagtcaatggtgtggcgatggttagcgaaattatgtgtgccgaaaatatagcggacaaagtatccgacacgattaaagcacttgaccaagtactttaaaaactagagaaaggtggtcctaggtaatgcttaagataaatggctctgtagagaatcagtacgttggaaagacaattgcacaactgctcaatgacaaaaatgctgctttagaaaacattgtagttgaacacaacggtaagattttacaacgtgaacgttttgtagatacttttattcataatgatgatcaaattgaaattatttcatttgtaggcggaggttaaaggaagtcttatgcacaaaattaatattgatggttacagcgttcaagaagtatatgaagatatgaaacaacgcaatgtgccaggaacgtcagaaaaacttgcacaggctcatgtgactattgcaggtgccggtggacttggctctaatattgccatcgcattagcgcgtgcaggagtagggcatttgactttgattgattttgatgctgttgagttgagtaacctgaatcgacagcaatttaaattgagtcaaattaatgtaccaaaggtgattgcgctaaaacaaaatatattagagttcaatccatttattacaatttcaacaattcaagaaagagtcacgtcgcaaaatgttgaagctctatttggtgatagtgatatcatatgtgaagcatttgatgacccgcatagtaaagcagtcctattaggtagttctcgtgaaatttttccaaataaaccgcttgttatgggcaacgggttagctggaattcatagtccaaataatattaaaacgagacaacagagcgaaaatgtatacatctgtggggataacattagtgctggagtagaaggattgatggcaccaagagtgcttgtgtgcgctggtcatcaagcaaatgtcattttacagctaatactcggtaaagtggctttataaatttaggagaaactgatagtaatgaaagaaaatactgataccttgaccattggtggtcatacattcacttcaagattcattttaggatccggtaaatattcctatgaattaattgattcagcagtaaaaaatgctgatgctcagataataacaatggcattgagacgttccaatgacgccaaggaaaatattttaaactatattcctgagaatgtcactattttacctaatacttcaggctgcacaaatgctgaagaaactatccgaattgcccgtattgcccgtgaattaagtggtagtgactttattaaattagaagtaattcctgataaaaaatacttaatgcctgataattacgaaacattaaaagcaacagaagttctggccaaagaaggctttattgtaatgccttatatgttgcccgacttaaacatagccaaacaattaaccgatgcgggagcggcagcaattatgccactaggagcaccaattggaaccaacaagggcctgtccaataaagatttgattcaaattcttattaatgagattgacttgccaattataattgatgcgggtatcggaaaacctagtcaagctgctgaagctatggagatgggggcagatgccattatggccaacacagcaatggcaactgctggaaaaattcctttgatggctgaagcattcaaattagcaatcaatgccgggcgtaaagcttatttagcaaaacctggccgggtattagatggatctgcttcaccgtcttcaacactaacaggagtaagtaatcctgcttaggatgaattcaaaaaggaagtcacatggaaaatacgatagacccaataaataaacggcataatagttgggtcactattattttattaaatttttttggttggatattcatatatgcagaccgtacaatattaaatcctgttatgccagctattcagtcagaatttggcttgaatcatagccaactgggtttgatttcgtccttgtttttcttaacgtataccatcgtgcaaatgcctttttctaccttagcagactactttagtaaaaaatggattattggacttggtttcatattttttggtgtgatgaccttattttctggattagtcacaactattggactattcttaattactagagcaatggtgggtattggtgaaggaagcttctatggcgcatcgtatggattatcctcgcaagtattaccgaaaaacaagttaacttttggaacagctttaattaattctggacaggcttttgggcaaattcttggcacattattatccagtattcttgtgttacagcttcattttcattggtctaccccatttatcactatcagcgtaccaactgtaatcgttggactactgtatatattggttatacgagacaagccgtttaatgcatcaactaaaccaaatcattctaagactgcaattaagtcaatcgacatcaaagcgctatttacacgtaatttgtcatgtacgtacttgatgctttttgcttcaatttatgggcagattgtaatgattacttggttaccgttatacttgatagattatcggcatatttcaggaacaaatgtagggtgggtagcatccattgtgccgtttatcgccattccaagtgcattattgtttgctagaataaatgattatttgaaaaatactaagacattgatatgtattttagttcctttatcggcaatttcactgattgtcggcgtaacgattaataatgatatggtcttgttactgtctttgctagtctatggggtaacaggaaaaatggcattagatcctttgctattgtataccattaagattaatgctaaaaattcgcagctggcaatgacatttgggatttataattttttggggatgattgcatcaattattgcaccaatcatgactggcttcttaattgatgttacgaaaggtatgagcattagtttttatgttgccgcattattattgatggcgtcgttagtttgctttaattttgtgaaatatgaagctgaacgagactgaacgcttatgaaaaatatagtatctttactaaacgaattcaaaaaaattggtttaactagttttgatggtgtgacgcgctgtgtatatgatgaaaattggttggcagcgcaaaaaaagtatatgcagattgctagtgactacggtctttacacttttgttgacaacattggaaatgtctatgcaacaacagaaaaaaacctaggccaaaaagtattcatattatcaggatcacacatggacactgtaattaatggtgggccgttagatggtgtttatgggactttagcaagtttgatatcaattggcacattaatgaaaaaatttggtcatcccaaaataccattggttgctgtttcattttcggaagaagaggggtcacgttttaatacagcttttacaggttcacggtatctcatgaacaagttagaagacacagtatacggtctgagagatcatgaaggtttatcttttaatcatgcacgtcaaaatgctgttactcaattaaaggaactagcatctgaattaaaagcgactggtctgatccacgcttttattgagttgcatattgaacaaggaccaatattagagaaaaaaagacaagatatcgggatagtgactgatattgttggtcagaaaaagctattgatcaaatgttgcggtgttgctaatcacgcagggacaacgccaatgaatatgagatgtgatgcaatgaaaaaagcagtcacattgattcatcaactttatgcggttttagatgaatttgtggcgttgagatacacaattggacaaatacgagttcaaccaaatgctgccaatgttattcctagtgaagttgatttttcattagatttaagacataaaagccaaaaaagattagatgatgcattcacagctgttaaagagctgacggaattgaatgatagtattttgacgattatgacggatgtgaatgccattaaattaagtgatcaattggcaaataacagtgctttggctgcgcaatatcataattcagcataccagtcgcttatttctggtgctggacacgatgctcaaattattgcaaaatatgtgcctaccacaatgatttttgtccctagtattaaaggcaatagtcattctccttcggaaaacacaaaatctgagcatttagtaaatggccaattagtattacaacaagcattgtatcaattagcttatatatagatgaaaaagcaagtaactttgatgttacttgcttttttaacgctagacatgttgttgaaaaaaataagctttgctaaccgagtatatgcatgattgaaattattattctatactagcataaaataatttattcacaaaattatttcactacttgaatgtaaaggcttacaagtttataatgtagttgtaattaaaaaggaggaaattcacatggttaaagttgcagttgttactggtggtggacaaggaattggcgagggtattgttaagcaactcgcatcagatggtttcactgtcgcagtcgctgatttaaacaaagataatgcggtgaaagttgccgaagaagttggtaatgactcaaaaggttactacgttgacatttccagtcatgaggatatgttcaagttagttgatgacgttgtgaacgactttggtcaattagatgtttttgtgaacaatgcagggattgcacaaattgctgccattgtagacgctaagcctgatgaaattactaagattttcaacatcaacgtcaacggaacaatatatggtattcaagctgccgctaaacaatttaagaaacaaggcagaggtggaaagattattaatgcttgttctattgctgggcaccaagccgttgagttgctaggtatttattcagctaccaagtttgcggtacgtggtattacacaagctgctgccaaagagctagcaaaagacaaaattactgtaaatgcctattgccctggtatcgtcttgacaccaatgtgggatcaaattgatgctgcaatggctaaaatttacgaccgtccattaggagagacaaagcaagaatatattgatggtattgcattgggtcgtggtgaagaaccagctgatgttgccaacctagtgtcatttttggctgatgaaaaatcaaattatatcaccggtcaatctattttagttgatggtgggattaattatgtataatagtctttgatgacgaataaaaataactatttaaattttttaaaacacataaataaagtaaataaaaccaatctatttagtaattcgggaaatcttcaaccaattgcgataaagttaacacaaggcttggatttggtgatacatgactattctttcgataggtattatggggcgataactttttctgaccaagtgttgcgcttagatttttcctacaatggatctgttaacttaatcaaaaataatcaagagacaatttttttggaaccgggttttttgaaaatagctcaaagttttgatgataataatcactattctagcgttagtggccaatatcaaggcattacattgctgatcaatcgccagaaagttagtgacgattttataaggcttgttggtaatgaccagctaattgatagcattactaagtattatttatccgaccaagattatatcttgataaaaacagagtttattgaacggttttttaaagattttgaagcggttgaagtaacgaatcaattgcaatttttacgattgaaaatagcggaattattattatatcttaattcagatgaggcgcacgaagctattttaccgaaaacttattttccaacaagagatattaagaaaatttatgctattcatggctatttgctgaatcacatcggtgaaaagttaactttgcagcagttggctagacaatatgatattggtcaaacgaccatgcagaaattgtttaaagccacatattaccagtcaattcacagtttcttgatgtctgcgcgcttggaatatgcctgtactttactaaaggatagtcaggccagtattacttttattgccaacgaagttggttatatgaatacaagtaagttctcagccttttttaaaaaagaaaaacaaatgacacctaaaatgtatcgtcagctttataaaaactaagtttagtaggctcattgaacgattgggctagaattaccaaaatagagcagtatactacatgaaattcctttacattaatcactagagtatttgattaaggaaaggaattttttattttatgaaaaagaaactctttgttgcgacactggtgtcgtatttgggaatttacattaccatgccagttttgtcagcaatttcaactaaagcacacatgataccaagtcaaattggtattatgatttctctcggtgctgcggcaatgttactgtttgcaccaatatgggggaaaatgagtgatatatttggtcgtagaatcgtgatgattattggactgttcgggatgggggtattcttcattctttacgtgatcttgtttcatatgtcaattgcgtcgtcaaaagcagtaccattattcttttatggattgatgggcactaggttcttgctaggcatattcatgacaacgacaccaacggcggcaaatgcttatatggcagatatttcaacgaccaaagatcgtgcaaaagacatgtcatcccttggctttgcaacagggttagcaatggtcttggggccaattattggtgggctgatttcaacaactggtaatctatatttgcctttttatacaaccattgttctcttgttgttgtttaccgttattatgacggctattttacccaaaagacaggtatcaattaacgaagcacacgctaccgacaaaaaagaaactgggtcaaaaaagtttttctcggttaaattattgagctggttgttagttggatgttctgtgatgttcgttgtggttgggttacagttactaacatcgctatatttacatgacaatattggtcaaacggttgttcaaagtgcgaagacctcgtctctgctgtttgttatattaggcgtaacattaatgttgacacaaattttgcaaattaaagtactaaatttttctgctcgtaagatgatgattgtcggaattccattacttgtgcttggcttattattgattactgtagctagtgccttttggatgttagtggtaagctacattttgattggtgcaggagctgcgtttggaatgagttcactatctgctggtgcttcacttgttgtttcacaggatcaacaaggagcagttgcaggtactgttgctatgacccaagcaatagctggaattgtgtcaccattgtttggttcatttatttatcaaatcaacataaagttaccatttttattttttgttgcgtttgcgattttaacttatttattttttcttgctaataattcaaaacgtgaaaatacattgagctagttcatagtaaaggagaaattagtctaatgacagacagtgataatcaacagaaatggccagcgttacccgccacattaagtaacatagcagttacaaaaaatagcggtaagtacgagtctgttagttctaattattttaaggtagggcatcctagattagtattcatggctgaaaatgatgaacaagtttcgcacgtggttgagtacgctggaaatgtgcagcgttttgttggacatcaaattcctttttctgttcgtagtggtgggcacggcataactaattattcagttaatgatggtggtatcattattgacctatcacagatgaaccaagtaaacatacttgatgaggctaaaggtcttgttaaagtccaagccggtgcagtttggggtgacgtggctgacaaaattagtaaagccgatttagttttgtctagtggtgactttggcgacaccggcgttggtggtttagcaacttccggtgggttaggtttactcgtgcggaaacaaggattgaccactgatcaaatactaggtgcaactatcattaccgctgatggcaagaagcgtaatgttaacaaagaagaaaatagcgacctattttgggcaattcgtggcggaggttcacaagtcggtatcgttactgagtttatttttcaagccgacaaagtcgaaccagcaaaatcaggacaaagagtaccaatcggtttgcaaaagttatcatataacgtattcgacttatcacattttttgtttacatggcattcttggataacaactgcgactgaagatatgagtagtttattaatgctaagcaaaagtgacagtacttcaagtattatttcggtgcaggcaacaaacatctggtgcggtgaaaaaacagatttgtgcgaaaaatattttactgacgcactaaacatcgccaaagttgaaaagcaagatgagagcaatttgagttatcatacattagtccaggcaccgcatttaccacacgaaggggcgaatgacgtctatgtcaaaaatgtactgttaactaaaattgatgatcatttactgaatgcattgcataccatgttaaaatctagtgcagtcatgggtattgaagtgcgcgctattgatggtcctataaatcagttgtcgcctgattttgatgcttggtcatttcgtgaggcaacgttgtttgttgctatgtggggagacgtcacacaatcaagtttattgaatcaattattcaaaccgctacaagagcatggatgtggtgtgtatggtgcttattccagtgataccagtaagtcagaaacaacaaaagcatggtcacgtgatacgcgtgaacgattgcaaaaggttgttaaaaaatatgattcaaaacacatcataaaccaatctagatatgcataaaaaagagcagagatatagttgactatatctctgctctttttatagttttttctgcatctttatatcagttatttcaaagccagttttctcgtaaacatgtatagcgcgagagttagtaccaaaaacatgtaggccaattgaggtgaaccccagcgcttttgcttttgtggaagctagtgcaatggcttgagagccaaaaccattattttgataggtatcgtaaatttcaaagtcaaaaataaaagcgatgttcttgttttcactgtctgctccaagccaaatatagccaataacgttgtcatcattgataatggagaagagaaagttatctggagtgtttaatccatctggcaatagtcggtcatatgttaattttgcattacccagcgaatcttcctgtgtccaactaccagcttgcactttttccaaagcgtattctttgattgatctactcatatagtcatcaaaatgcgttgctgtcattttttctaatcttaacattgttatctcctcgtatttagttacttagtataccatatcaatcacaattgccctaaagggcaaaaagtgtgccctttggtacgatgtgtaagtctctttttgttgatatagtcaatatattaacttagaaggagaaatatattaatggggcaattacttagtaaattaggacggtggatatatcggcatgctaagctgacaattgtggcatttttcataacaattgctgtatcagttggtgcggctcttagctttggtattcattttgatagtgcggggatgtctattcaggggtcacagtctgaaagagctaataaactaatggaaaaggagtttccaagtactaggcaaaatggtggtcaggtacaaattgtactacactcaaataatggtaaagcattaactactgataaaaatcagcaagtcatggcagaactatttcaagatgtacaaaaaaacagccatgtcaaaatggtgattttgccagctatgttaaatagttacagtaaagatggcatgactgctacagctagggtgatatataagcaaaaaggcgaaaatgtttcagaaaaaacagttgacgcattagagaagtcaataaagattacacgacacaaaagtattcaaacagaactaacttcaaatgatgttacgatttcaggtatggataatggtgagcaggctgaagtggttggcttggctattgcatttgtgattttagcaattacttttgcttcactattggtcgctggaattcctattttatcagctctattgggtctggtgactggtatgatgttggttttgatttcaacgaacttcttatcagtagcaactttctcaatgtcattagttggaatgatgggattggcagtcggaattgattatgctttatttatcatttcacgttacagacaagaattacagcaaaataaatcaaaaaaagatgccttatcggcagcgatgtctaccgcaggtacgtcggtgatatttgctggggcaacagtcattgtcgctttattaggtatgacagtccttggcattgatatgctctcagtgatgggtattactgcttctttggccattcttactgcaattttaacttccttgacttttgtaccagcgatgctggtcgtattaggtgatcgagttaccggcaaaaagccaaaccgattgttacaatttgcaagtaaaatgcgcattgaaggtggttggggtaagctagtaaccaaatataagttactattaacaatgttggtggtcgtggtactgggtgttattgcaacaccattcacacatattaaccttggactacctaacgattcggttaagtcagaaaaactaactgaacgacgcgcatatgatttgatgacagaagcctatggcgagggtagtcaagcaacattggtcgtgttactaaaaacagatgacatggtaaaggtgagcgatagtgttaatgagattaaagatctaggaaatgtagccactgtttcacaagctatgccaagtaaagataacgattatcagatgattacggtcattcccaaaacggatgccaatgctgttaaaactaagaagctcgttcataagatacgtgacttgaatcaaaaaaagggtttgccaaggttgtatgttacaggatctactgccatcaacatcgatatgtctgatgcattaatgaaggctttgccaaagttcgcaattattatcgtgctattcgcattcattttgttgacagtcgtatttagatccttgctgattccattggttgcggtgctaggatttgtgttatcattaggggcaacattgggcgctattgtgtttatagcacaagatggccacttcattaacttgtttggtattccagccaagggcgcaatacttaatttcttaccagttcttgtcattggtattatgtttggattagctatggattatgaagtcttcttggtcagtcgaattcgtgagcactatctaaaaacagagaacactaggcaggcagtaatcttaggcatgcgagatagtggaccagctgtcgtggcggcggcacttattatgatggcggtcttctctggatttattttcgctagtgatgccattgtaaagtcgatgggattagtattagcatctggaatcttgttcgatgcgatattggtaagactaattcttgtaccagctacaattgatctgtttggaaaagcgagttggtacctgccaaaatggttggataaaatattgcctaacgtaaaaatcgattaatcactaatatcagttctataagtttggtactatgataaaataattgagtatgaatgtttttggaagggaatctacgtatgagaaaaaatctagatgttgaaatgaataagcatatcatgatgatataccgttggccaatgattttttggagtatgatgatttacttcttagcgtcctattttaaaaccgaatatggtggtgtccaatcaataaactctgcattgtttttcaatgtggtgtttttgcatttgtgtttaaacttttttagtaggacggtcatcaattttagtaaaaaattctttatttctgcgcaatttattttgattgttctggcaggtattttgcttattccttctgaagttgttctatatatgggcatgttgccagtaatcggtttacaattattgacattgtttaacatcgagttcaaaaaaatggccttattattagtgccacttcaggttgtgtttcttataatagagtgggtcaattttggtcccttaatggcgttgattgtattgcaagcttctacttttctcaatgtaattattttcttggcatggcgattctatcaaaggcaagttagtgagttagttaaaactcagcatttactcgatgagttacaattgacctatacagaagtcaaagaaatttcgaagcaaaatgaacgaaaccgtattggacgagatcttcatgacacgcttatgcaagggttagccggcgtgacaatgcaattagaaggaattaaatccttgatggcatctgataaaactgaacgggctagtgaagagatagaaaaaacgatttcattgtcacgaacaacactaaaggaagcacgtgaaattgtctttgatatgcgaaaagataacagcaaaaacatcaatttatatgatcgacttgagttattgtcaaaagtgttttatgaaaattatggtctaagtgtgcgcataaaaagcacttcagatatgcgtgtttctgaagatgtgtacgaggaagtatctagaattatttctgaatcgttgacaaatgtggttaggcattccaaaacagatgtcgcaattgttaaaattgacatggatgatcaattacggattagcattattgattatggcgttggctttaatgtggaaaatggcaaaagaaaacacaagcactttggccttaaatcaatccaagagcgtgtggaacaattggaaggtaagctattagtcaaaagccatataggtgaagggactgaaattcaaattcaaattccaactaaattgaggtggcaaaatgaccagtaagataatgattgttgataatcattttattattcgtgaaggaattaaattaatttttgaaagtcattcagattacgatgttgcttatgaagcagctgatggggatgaagctattgatattatcaagaaatctcaagttgacttagttctattagacattaaaatgcctaaaaaggatggctttgaggttatgtctttcattcatgatcattttccggaccttcctgtcgtggtactgtcaacctttgataatgttgtgaatatacagcggatgttgaagttaggagcgaagggttatttattaaaagatgctagtaccgaaacgatttttacaacaattgatagtgcaataactggaaacatggtgttacaaaaccagatttcagacattctattctctcagaatcatacagaaacaagtccagaagaaacacaagattacaatttatcagaaaaagaacttaaaatattatctcgtgttgctcgaggggttaaaattaagctcattgctctagagatgcatctttcagaacggactataaagtctaatttaactgacatttacatcaaaatgaacgtatcaacaggagttcaagccgtggctttggctgttaaaaataatctgattgatattgattaacatatttttcgtactaaaaaagcagacttgtcatctgcttttttaaattactagaagttaggatataatatatcgtatgacaattaattacagtagaagccttgtaaatcagagcctaattataaaaagatgcgcacacgaacttcaaactgcaagatatcaatatcatgattttttatcgattggcattgttgaaggtggcagttgtattgcaaatattgataaagtgaggcacattaaaaagaatactttggtcattattcctagtcagttagtccattggtgtcagccaatagacatagtgaactggcgttacacgatgctatatatagcatcgaatgcacttgaagatcagtttaatcaaccaatgacgattaaattaactagcaggcaaatgcagcaggtcaaaatgattatggattctgctgtatatgaactgtctcctacgaatatattgacgaaaatcattaatgtactcgatgatgaagaaatattatctttttggaccgtgaattccgtagaaaatatggagactagacgattcgaaagtgttcaacattatatttctattaattttcatagggagtgtaaagtagagacactagctaacatatcaggattgagtaaatattactttactcgtttgttcaaagaaacttttcatatctcaccagcaaaatatttgatgaactatcgtatgaatagagctgtgaaggacttgttagataatacaaatttgtcgatgtcggaaattgctcatcaaaatggttttttgacgaaagtcattttgacaaacttttcaagcaatatcacggtgtttcaccaaaaaagtatcaattacaattatcttaacattggtaagctgccgctaaaatgattgactttcttttcgctgccatataagcaaatccccaaaaagttaagatcctcatctgtactctgcttgagctttgctttatattcttcataattattgacttgttgtgctacgtccacaaacgaaatgacctcaatttcttcatactggttagcttgacggtgaatctcgttaattttatttgaatcagctttcaaaataggaatagggatattgacaatgccagggtaaagttgattatttttatcgtaagtatcttctccgttgatttcaggatgcgcttttcctaatgaacaacctaatatgcttgctgtattggcaacaagaccaattggcagttcaggatctactattacaacacacttcattttcatttttaatttttccttctttgcaaaattttccatgtatattattaaaacatgttctaaaaagaaggtattgtataaacttgctatttaagcaaagacgtaacttttttatatacttttacgaagaactaattttaattccctagacagcttgtttctccgttgcgtaagtttttcttgtgttgggcagttgttttcattgaacatgattttcctgtttaaccaccaaactgggcctggtgttggcgtatcatttttgtgcctaggaaataagtgccaatggacgtgtgcgtcgccgttaccaagtagttcacaattcattttcagcgtcaaaagctagcgcaacggcttcgttaacaagacacatttcttccaaaaatttgcgtttgaaatctgtttgtaaatgatgcagctcggttacgtgttgtttagacaaaaacaaagtatatccttcaaaatattgatgatcaccaataacaacataccctgtttctagttcagcaacaaagtaaggattagtgccttcttgaatcatttttattcttcgacatatttcacagttattcattttacaacctgagtttcgttatttagaccattatatcattacttaaacgggtgaattattaaaacaaaagattctgcgaatttgaaagtcgcacatatttatcatatgagcgtatatgtaactttaattcaattctttggcatgtgttataatatcctcagtaatgtaaagaggtttgataaaatggatatttggcaaaagctatatgaagctgctaaaaaacagtatcgtccgacagaagtgaatgaattcatctatgcgcatcatgttgttagtgccttggaggcagaaaatggcgatatatatactggattttgtattgaaggtctatgtggaacgatgaacctttgtgccgagagaacagctgcgttgaatatgtatttaaatagcgatcaaactaaaataaagcgactcattgcttttagagatgaggctccagtcggtattacgggtatgccatgtggcgtttgccgtgaatttttaatgcaactttcttcagaaaacgcaaatactgaaattatggtagattatgacaacagagagtctgttaccttgaaagagttactacctaagtggtggggacatatgcgtgaatgatgatattatgcaaaaagaaaccaataaaatttttttttttgatatcataataaaaacttgtaaaacccagcaggtatgttactatttatatatgaaaataaattcatgtataaattaggagactattatgttaaaagatgtattgacagcaattttttcttatatagggacaacaacggattattttgttgttctactcttgctctttggaaaatatagtacaaaacaagatacgaaattagttgttttaggcgcgtacttaggaaatggattactagtacttacttcaattattatcgcgcttgtattacagcaagttccggaggaatggcttcttggattgttgggtattattccgatcataatcggggtaaaggggtattttagtaaagaagacgaaggggaagagatagaagaaaaattaaagataattaaaccagacgctatcatttggaacgtgttggtaatcactttttctgcctgtggtgccgataatatggcgctatatataccatattttacgatgctaaatcttcaaatcttaccgatcattttagtcttgtttattattatcttgacggctgtgattgtggcagcatataagttggtaaacgtaccaatcgtaaaggcattttttgataaacaaggcgatttagttcagttaattgtgtatgtttcattagggctatatgtcttagtagaagccggaactcttcagcacctattactgttaatctattaaaacctttagtatataatgataggtaatggcatttaagatggagaaggtaattatgttaatgggattaaatcacgatcaatttgttttagtgcagcggggtacaaaaacaattgaaataagactctatgatgagaagcgagcacaattaaaaattgggcataaaatcttatttactgatttagagaataacaatcaaataacggttagtgtaaaacaattatacaagttcactacgtttgctgatctctatgcacaatttaatggtgcaaaggttggtagtaattcaactgataatatcgaaaaaatggttaacgatacttatgaaatatatactcccgaacaggagagacattacggggtgttggctattgaaatgttgttaggtgattgatcagtaagtagtagttaatattttcaaaaatgatattattatctaattactaagaacgtaatttacggcactctcgaggttctgaactgtaataatattctttttttgttgattttgattgtcaataaaatattgaggttcgaatttacctgttgcaacatgaatacccaatatttgacaattctgagctaattgaatatctgatgaaaatcggtcaccaataatgatggattgtttgttttgaaaattgtatttacgatgagcttgttcaattaatccttttttaggttttcgacaattacagtttgtttgttcggaatgagggcaaatgaacgcatcatcaaacccaactctaatcagtgaattgaagaaatcataatagttcatatcgcctttttcaatgtgggtttgatttgatagcgcaaatacactcattccatgtgcttttaatcttgcgattgaagaaagcgcataaggaaaaagttcgaaaacgttgagtgactgataatggccgttaccaccgatagtaccatcacgatcgataaaaacggtcgtataattatttagtatattcatatttttagtatacagcttattcatgaaggtctgaagcataatgaataaaattaaaatggaacaaaaaaatatttcctacaaatcattaatccatcaaaatcagacaattctttcaagcgccaccgttattatatcagttcaaaaatctacaaatgaaagagagcatcttagggttgtttatgtttcacatgttaatagctctgtctcaaaagagttcatatataatgccagtgaagatgaaaataataaaacgcaatggattccacttatttagatattaaatatggcaaatattgattactcagattggtatattcttaaagcgttgtataaacaattgatagtgtaggtaattataatcgaagaatgtatacttaagagcatagagattgggacagacgttgaaacacgtttgtaacaatcgaagtgctttttaaatcatattgcttttaaatattaagaaagtattaatatgagaaaaacgcacaaaaaaaccaatttcacaaacatttgaaaatgaatgcagaattggctttgtacattgactgatgaataaaatgaaattgcacaaaagcaataaatttatacacaatcaatataaccgtagaatagttatattataccgtataatctttggtttgtgtcatgactaaaatatcttaatattttggttcggaagtaaagagagagtttgtctaaacatgagcatcagaatttgtgcttattggctttcgttatgtagccctaaagagtctatgcttttcttgattggcacttgagaatatagctatcatgctgtttagagagataccttaataaagtatccgcagtgttgccatagtttagcagaactgtttttattgtcagtaaaaacatcgttgcattgatttaaaacatgtctataaaacatataaaactgaataaaattcaaaaatgttgttttagaaaatatatgctataatgggtgtatgaaaaagagccacagcacaaactatggctcctagcaaacccgttttcggcggtggctaagttttagttattggaaataaccgtgactctccaaagttcgacggttatttttttctgctaattttttctattagtagaactacaaacgttagtaaactgatgataaagataccaaaagctagtaacgtttgcagtgtgtccgaaagggacatcaggcatttcctttcctagaatctgggtttacagtgattacaccataagcaccacctccgttcgggatagccaccgtcttaacttgtttgcttcatctagtataacatatgtaaaaacagtaaaaatcgggtaacaattgtgaacaaaacttacttcgcttttttctttataagttaggcaattagtgttctttgattattatgattagtggcatgattttagcatatagtgtcaaatcaagccttttaacttaattagtcgaagttgtagttatccgaaaatgattgattttcagattcaacttttataaaattgtgttatgcttaatttcaatagtgttaaaaacaaaataattcttctaatttttagcttcgtaatatttaacgttattgaatattatggtggagactttgtcgtaggactagtgaacaatgttcccacaggtgatttaagactaggtgtcatgttaaacgatgcggcatttaaagtgtttgaattatttctagctgcaatactatgttttattttacctgttcctaaatatttcaaaattatattttcaagacgaacggtgagatggcacattattttattgatcagttcaatattattgagtatttttaatccagaacgtttctgggaagctttatttatcggaacggctgctgcctttccagaagaattcatttttagaggaatttttttaggatatttgttgaaaacatttaaatcaagtaagtacggcgtgattatcagtctagtcatctcaacagtattattctctgtttaccattttggtaatatttcaaaccaaaatattgaggcaaccatacttcaaatgtttggtgtggcaggcattgggttcatgttggggtgtctttatgttaagactggtagcttactaattcctatgattgctcatttcttttttgatttttttctgactattatgaatggcatgcaagtctcctataaaacacaacagtttgatccaagtacgatttccgccgttattttacaatttttaatttttttacttataggaataatgattttaaaagcaaaacattctgacgattggagattaactaggctcatatactctgaaaatggcaacaagtgacattaacttttaaacatgtggcctaaatatcaatattgttaaaattataatgactagagcaaaaatggaaaaatctgtttttgtttttttatttcaaattatcaaagtagagcacttttaaaaagcaataagttaacaccagactattcaattacaggatcatgaataaatttaatgaaggataaagttgctacttttactaggggaaagcatattttgattgacttttcgtggcataatagaaggataagattattagcattttttgatgattaaaagttatgcaatattaataaggatccttcaaccatgccatcagaatcaacaattgaaaatcaatttattcatattttaagcgagcaagagaatcaatggcgatatagaccagaactaaaaacagaagccgatctttggattaattttagaaaccatcttaatcgtttgaatacagctttgttagaaggtgagctcttaactgatgttgagtttgatcgtgtaaaagttgaatttttgcgtttaaccagttcaccttttttagcttcacaatggttgcgaggtgaaaatggtgttgctcaaatactgttagaacgagaaacaggtgagcggattagtcttgaagtatttcgcaataaagatattgccggtggcacctcagcgtatgaggttgttaaccagattgtgccagatactgaacgcagcactagaggtgatgtgacactgttgattaatggtttgccaattatccatattgaactaaaaaaagaatctgcaaaagatggttacatgcaagcctatcatcagattcagcggtatgctcaagatggtttctttaacggtatttatgcggcaacgcaactcttcgttgtttcgaacaaggttgatacacgatattttgctcgtccgagtgaagatactgatgccgcttatcagcgaatgactaaatttttgttcaattggcgtacagaagaaaacgtaccggttcctgatttgtttgattttgctcgtattgttttgagaatacctgatgcccatgaattaattagtcaatatacgattttggttgatgatcagaaaaaccaaaagtttttgatggttcttcgaccttatcaaattcatgccattcgtaaaattagaaaacaagccgcgctgcatgaaggtggcttcatttggcatgcgactggttgtggaaaaagaacgttttgaccaagataaaaaaattcaaatttcgaatgaaagcatcttaattacaaaagatggaactcttggtaaggttgcttatgttgaaggtttaactatgcctgcaactcttaatgcaggtgtttttaacgtcaaagtgaaagaagatattactataaatagcaaatacttgtttcactatttaaaagcacctttcctcttgaattttgcagataaaaaatctaccggtggaacaattaagcatttgaatcaaaacgtattagttgaatttcccattccattaccaagtttggaagaaaaaaaagatagctgaattattatcaaattttgataatactatcgcacttcatcaacgcaagttagatttgctcaaagagcagaaaaaaggtttcttacaaaaaatgtttgtctcatgaggagagacaataaataattgaatattatattaagttcagacaaattagtttgggctttttttatggaagttggtagtcaatgaataatttaaacataattgctaaacctaaacacaggtttagcatagatgatgaacatttgttatctaccgacatagcgcttattaaatggtttaatgagcgacaaggtcttataggtttgctcacagaagaaaactacaaagcgcctagtgagtatatgcgtaatgaatatcatcagttagaaaggacgtttaaacgatattatgagtgaaaaagaaaatgcaggggataagaaaatatccttagctttgcaaggtagttggtcaaacagtacaatatgcacaactcattgaagatttacaacctttgcgtgataagtacgacattacagtgtcggtagatgcaaaactttaatttaaaatacaggagaatttagaaacatggttaaagcaacaattaacaattttgaaagcctagcgctttctggtaagactttaggaaacttaacttattcaactcgcaagagtgttggtaagcgtagtgatacagatacggctgttgtcaatatcaacggtagtcttgatacactcaacattgagccacaggctggttttgattttggtatgccgtcaaagtcggaataaatgtactcaaatttaaggaaatatactataataccagtaattaaaagaaaagaagaaaagtatatgaatccgattattccaaaaagtccagaagttcctaaattatccgaatccgaaatagaatttttaacaaatactgtttttggaccgaaaaaatcaattataaaatgcgatgctttgtttgtgtttagtggtacacatccagggcattgggaaaaaacattagaggcatacaatgaaactggtgttgataaaatcattgtcacgggaggtaacagtttaactgggaaaaaacatcctgagtggcaatttgacaatcaaaccgaggcggacgtttattattgattatttaatcagcaatggtgtttctccacaacaaattgtctacgaaaagtcgtccacaaacacattggaaaatgttaaattcgcactgaatgtatttgatttttctcaaataaaaagtcttatgtttatttgtaagagtcatgcaactggtaggcaacttcggacattaaccaaatatttacctgcaaccattgattatattccctacacattcaatgctgaatattccggtaatattgtcagccgacaagaatggatgaatagcgacatcggacagtcaagagtgtggggagagtatttgagaatacttcactatgggcaaaagggagatattacgcctttaaaaatgaactaatgatcatggatcatttttactacatgtaaatataaattcaaagcgcattcaaatcgatgggctttttttattcaatttcagaccatttaactctactatcttaacagacgtcgttaccatcagaacagaccaagttaagtacccacgcatcaaagacaatgacaggcatttgattgagcacatgtggaatgacgaaaaactaacataatttgaaattgcaagaaaactcaatcattcgtaatcagcaatctcacgagaattaaagcaaggaaatattttagccttacgtggtccattttttgctacccaaaaagttgtctgatgtggcaataattcaaaactattgccaccagaacaaattgtagatgcagaaaaattttaacttaaaacgcagtatcaaaagcagcgtgagattgatagactacgttttaagttaaagaaaaattcgcttgcaaattccttaaaatggttacttttgataatatatattatgttaacttgaatttgtcaggcggatgtcaacctgaaaaccacatgtttaatattttagtaaacttctggtaacacgtatgtaaaactaacgaagattatttttatatcagagcacaacttttttaagaatatcatgattttgtctaaaagtaaactgcatgtccacgcttttagaacgtcgatacaaaggcttttagcaatctaattactcactattatatcaaatatttcaatcaattaaaccattttcaaatctttatattttaagcacaacaaaaaaagacacttctagtgtctaaagttcattattttattgttgtgcttaaattcgcaaaaaatattgaaaaataataaaattacgacctgagccttttgttaatggccattataatactaatactttcgaatctttggtgggatgtaattattcataaaatcgaatattatttctagagaatcagaaaaaagtaatttttgacgatcttccacagttaagaaaccatgcgctgtcatagtatcaaacattttttttaactcatcataatagccattaatattataaaaaacacacggattattattgttgcctaagcgtgcccaagaaaaagcttcgataatttcttctagtgttcctggtccacctggcaacgcaagacaaccatctgataagtccagcattttttgctttctaacagacatattttctactatcgttaaatcagttagtctttctaaggctgcacctctgtcagctaattgatttggaatgataccatgaacattaccaccaaaatctagtacttgattagctagtatacccatcaaaccaactctaccgccaccataaaccaattcaatatgattctgtgctaaatattgacctaattctttagtagcagttactactgcagaatctttccctagtgatgcaccacagtaaactgccaaatttttcatttttatataacccttttacatattctaaatttaaataaaactgattaattaaaacgttgtttcaatttcgtctgactttgtgctattaaatcatctaaatctatattatatttttcgcttaaaatcagtacttgatctaaaacatcagctagttcttcttttaaatgtgcattaagctctgactgattttgcatttcttcaccaggatgatctctgcctagttctattgctctaatacattgggctaattcaccaacttcttcaaataaaaaatttaatctgataaatgtcgaatattgaaaccaattgcgttttttatagaagcttgttaaccacattttatgttcctgcatcactaatcttcctccttagtgttagtatgtatagtataatcaatgcgtactaattgattatactatacatatatattttataaaatgagacctgtcactttatttagaaatattaatttagccactacattactgactataattggttacccttcatcattttggcgctcttctagcatgcgctgtttacgcttttcataagctctacggtaacgttgcatggctttatattcttgttcaaacactaccattggtcttttgccgtccaatgcttgtctaagtggcatggcattcatttttgaagctacttcatctagttgtcgttgcttcacatctttaaatgacgtacctttagggtaccaatcacgtagcttacggtttctgttttcatttgaaccacgttgttgtggtgatgacggtgtagcatagtatagcttgattttaagctctttttgaacatattctaaaaagtcccatgagataaattcagaaccattatcagcggtaatcgttcttactgctttgccatatcgttcataaaatagcttaaacgcatcaatcatatcattagattttttactacgaactaataccaaagcagtaaaccgagtttttcgttcagtaaatgtcataatcgcagtcgtatcttgataccgtagattattcattttagcaggcagaactaaatcaatttcccaatgaccgaactgtttacgactttcaacaacctgtgagcgatcaaatattgagtggcggactaattctccgtcatttttgagttgctcacgaagcctagcaatttcacgttctttagcacgtcttgtttgcgcaacagctctttcttttggtgtcccattttgtcgatgatacttgtgtttacgaatatcaattaaaccttttctagcccataatctaatgactgatgcggaaacatcaacatcttgaacgttgccagctatttgttcaggtgtccaatgttcaacattaacccaagtttcaatgatttcttttaattcaggtgtcaatcttgaaccggtacccattttactacgtttctttaaggctagatattgaccacgttgtgccgaatacttgatacgtgcgtgtatatccatattcaaaagcgttcgtctatctaaatgcgaaaaatcaagtgtgttgccacggtgtaattcacgtagtattgatgacggtgtatagcctaaacgcctagctatatccgcttgtgtcattttctcaatattccacaagtattcaatcatgtgacgttgattttcatttatatgtggttggcgctttcgtttttttggtgtttcatcactcataaaacgtatatactcctttattatgattattgaagttgggaatattcccttataacaagtttaccatttcacaatgttgtctattattttattttttaacttatcgaaaaacaaaattataagcatatcaactgttcacacaacattgaattcatcaagaaccttttttacatcagctagttcttcataatattcagatagccaacgagtatctaaacgcatacgttcaagttcaggtagtaaattgttttccaaattttttgcatgttctgacaattccctcaaaataaaggcttcataattgtttacatcatcaaatggtctaaagacttcatcagtaaaatcaacaatattgtgaatgctataagctatctgccctataattttgttattatcagaccattttaattgttcacgcaaatgactatcaacctcaatatcacgtaaacaatcaacataacgattgatgatgcgataccttaaattgtcaattgctttgtttatcatcacattgccctttctcttagttgctttttagcttgatacaactgttcttcaatcttattcaaaccactttcagtgttgcgatcagttcccttaatcagcaagtctaaatcacgataagcaaaggttagctcaattgattttgagaccaaatcttgtacccttgatgctaattctttgttaaaaaaaagcacatctccgtatgtttgagattgtgcttgtctgattttagcttgtaattgcattgatacgcttaacgttgtttgaaagttaggcgcaccagccttgaattgaaagccttgtctatcgctttctaacgtttggtctaattgactatataagtctctaaatcgttctaactgcttaatatacagctctaattgttccggctttaaccatatttttgttggcatcttactttatcctttcagttttaattgcaaacaaaaaagctagtacctatcaagcactaactcactttgtgactaatcatatatatttgtacgaaccgtcaaacctgtttctttacgaattttcttaataatttccggtatttgttctgtatatgaactatccaatcgtgctatttgttgtgaatgtgttgcacgaccaatcttataccattcaaaaaatatattgaccttttttgagtagatttggtctacaactctcacttcatatatcgtattaggttgcttagcaaacatttctttaatatccccaattaccgcatcaatttggttcatagctcaaacagctccagtcgttttatttactataactattatacgaacagttgttcccttagtcaacagttaaacactctaaattatttagggtaaatactgtttatctttaccagtttcatcaataattcgtaatggttcactataaatttgttgagtactcatagtacgtctaggtgctggatattccttttgtaacttacgcatcacatctgctagcgtagtgcctatcatgtactcattctttgaatgccaaccaactgctttatacattatcatgccccctttccttgttcatcatcttcgttgtattttttagtcggcttttcaaagttgatatttaactgcttacttgcctgtgtaatcgcatttttagtagttgccataaccagtttttcgtgttcagccgataattccactgcattgattgcttcaatgatttcatgccaatgtcctgttttcttcaataccgctagactaggcacaaccgactgtaaaacccatttttcaatacgctcaacactttgcttttttggctctctaacaaatttcattttcttgcctaaagctgttagtaacgaccaagcaggcatcggctcaaccgttgcttcaatctcatcacgcactgtatctgatttcaattgttggtcatcaattttgccattagtaaaccacaaataggtatacaaaatatcaaaggttatatccaccaatttcttatcttgattaagccactcatcaaggacatactctgctttatcttgatgcaattctaattccacacgagtttttacatcagtgtcatagcctttattagcttgttctttgtgcttatcataggcacggataacaaaaggcgacttaccaaaatcaaccgtccagccgtcatcaacgttgccatgcactgcataagactttgatttactccaaaaacgcttttcctgtacagccttaacaaggtcattcatgttcagcagaccccatttatcattgattgcaatatctaatcgtgttagatgcccccgatataatcgtgcttttgcaaaaaagtcatgccaattcatactctgctctaacaaagctttttcaaacagccgtgtgcctttaccagttaaataaagcgttgtcccaaatttttgatccatagcctgtgtttctgggtttttcactggcgcaaagtcttgtatgtaaatatttttttcgccagcaaatgccatttcacgagtataaaagttttgagacgtaggacgttctaaaaacaaattttcctgcaaacgtaacacatcagcaatcacttgctttgaagttaaatctgggaacgttaatgaaacccaatcgaattgtacttcaatgctttctgctaaatctggataggctactaacaatttatcaacaaacttatctgatattttttgttctccattttcaaaacgagtaactgtttttctactaatatccagtgcagtagctaattcttgttgtgttatcccaagcagttgtcgcatcaatattaaattatcatttgttagttctggtgcatttaaatcttgtgtcataatatttttccctttcaatagttggtatcgaccaacgttttttaaatcgactaatttttctaattcagttgaagccgtattttgtatttttgcatcagactgtttaagttttgccttaaagcctgataattcactaccagtaatttcatcaatcgcaatctgactaccgatattaggtaattgtcccaattcaatggctggtacagttacgttataagtctcaacaatttcatcattcaatttcataccaaccatgataagtatttccaacgataaccgtaaactatgttgtgttgtgcctagaaatataggtgtataagctgttggctcattgttaatcgttatcatgtcggctttccttttttaaaatgtcccatttggtactttcaaagggacatttttgttttttgttctaaatggcttcataccggcgtttgttccccatattgggttgacgctttcagcgtttttaccggtttaacccccctgttagtaactgggggttaaagcctttttggtgactttatttttggcgcatgtgccagtcgcttacaaatgctttgcatttgcttaacagcgaccacgcacccagccccaacgctacgctagggctgggcgtggcactgtctcttcctttggtcgagccacgcctaaaataaagtcactatgtacataaagccccggtctctcacaggacatttgctgtaaaagactagagctttaacaatagttacttacttaatatgtgacagttgatccaaaagaccctcaatatcctttgtacgattgacaccgtgtgtctgcaaagacttagccgtaccaagcaaaaaacctaaatttttacgtagttctgcaaagtaaggtggaagcattgggctaacagcacgtaactgttcctcatctgccattgcttttttaagttcatcacttagttgagcaaggtgttcaagtccacctatcttttcaattgccttcaaatcttcaattgattgagcggacaaagattgaatttttttaacttctaaagccataattttttacctactttttctttttaaactacaaatatttaattaacagcaaagccaaacacagatgctaagtgttggacttcttgcgtggtatttcatcatttctaactcctattttctactagaccaatcaaggtttacataaggtacgctataaaaagtaacgctatatcaacgttttaaagcactaaaaaatagaacattttcaaaacctttcacaaagtccttaaaacgcctatttcatcacgtcatttttaaaatttcacaagtaaacttgttttagaccaattttctaaactctttgatgtacgcatctaactgttcttgcgaactttcaatatgcttcatcaaatcgacaatatcctgtgtaaaattaaaaacatcaacatctcttatttctgcaataaatcgtaacgctttttcattttcaattgcgccactttcaacatcaatattcttaacaatatttctaatgttagccatttcattggcatcaatcgaacgtaacttatccaacatcaacgacatatttcttgaaccattcactagacttaacctagttcgctcaattgccataatatcatctgccattattttccctgtctttctcttattgcgatattttcacgcatgtattcatgtaaattaaaatcttttggtacttctggtgcaaagaatgacctgacttgactgtccccaatcttaataaagccccaacctttcaaactagatgacaaagggcgcaactgcttttcattatcagggaataccattttttcaatttcaggtgttggcacacccatgttaatacgcatattcaattggttacgtattgccataggtaacgtgcctgcatcaggtctttgcataccaattaaaatataaaaacctagttcacgtcccaacatagcaatctctctaagatttgacattgctgtctcataactagctttagttgggtcatcataagccaatctatcattcatttcataataagcaccaaattcatcaaacactaaaaaataaggtgtaaacccaaaatctttataagtcccaactttacccgatgctttaattgcttcaattttttcagcacgagccatcattttagtataaaaatctatcacagcttgattgatttcagatgccacactaaaaacattattttttaattcaggtacatgttttaaaccagctaaatcagaccgttttgggtcaatgatataaacaaatttagtaacctgtaataactgcccaataatcgcaaacatagtataagatttaccagtaccaacgttacctgatagtaaagcattgtagaaagtatcatacttccaatcaataccctttgaaatttgcaataacccttttttaggtttcaattcttctaactgtcttctaaacttaatcgggtcaaaagcaaaggtactaatcattttatttttactaaattcacttgtttgtctatcagcgagtaatgctgtttcaacaacattatcaaactcatttttagaaaaactttccatgtatttctggccgtctactggctcttgtaaaatcagttgacctgttttgtgtaatacctttaattttaattttgggaaataagctataaatgtcccattatcatcactagcagtatcaaagaaccctttggaaacaatcaacaggcttatcatctggcgtaattcaactgttttcaggtactttgaaataaagtcggaatgttctggggcataattcttgtaaaaccaaaaaaaaccccaaccaaacaaaccagtcaacaagatgcttaacacaataggcaacaaataccaccaactatattgtccttgcatcaaggcttgaaaaatgtttaaataccaaaaaccaaaacaaactgttactacaaaccaaacaaaaagcaaagtccttttaaataaagtctttgctaaatactgatcgctgtatttaattttcttaaacactaactattcctccaacatattaaacattacaaattcaaagaaaaaaaataaatcaaacttgaaaaaaaaccaaaaccccaaataaacgctaccaaacttaatttccaatcttcccctttctcaacaaatataatgtaattaaaccagataaagaaactaatcaaaaaatattttaataagtctatccaattcataaatgtaccccttatcaattacccgatagaaaacgacgacacgtcaagccactaccagccaataaacgccactcaacttcaatgtttgaagcatctgtcttacctgacttcaaacatctttcagcttgtttgtaaaaaccaaataattcattatcataaaccctaaagcaagccacactagaataaaaaacactattcactaaaaaatcatgaaatttatcagaacaacgcttagcatcttttacatcagcaatagtaataacaccgctctctctatacttcggaaaataagattgtttaaattcatcaactgttaagccaaacattaacgttcactctccaatctctgcatctcatcattgatgacataatcatacatttgatgtgtgaattcatttctaaatcgttcaaatttttgaggactgcccttaatctcattcaaagtaagactatgttggtcgggataaggactatcactagcataatcttgccaagcaatctttccatgaacattgataattgcttgagctaacaacaacacatttttacgtgtcatacgatactttttaaattcactcatgattaaacctctttttcatcacttttaacaggcacataatcatttctaatcaatgccgataattcattgtagctatcaatatattcaagataattaccaaaaatatctaagctattataattacctgctctaaccattaactttgcttgttttgcaaaatactctaacgacatatcatgataaataaaagcatatcttgcttcatcaaaatctttgatttggtctttgattgctaaatacttatcatgaaataacttataagcacgattagctttccgtgaaacatcttcattcacaagcataccctcggaataaccaagcattgtactttgtaaatctgccattgtaaaatcaactttagtcatcaaccttacctctgttcgttacatcaaagcgaaccacatctcgctttttatccaaaataaccgtaattgtataaccactggcttcaatctttaaagtaagttgctttttatcaaaagcagtcactgtcttaccagtaatcacaccagttgtctcttgaatatcttttgacaaatcactagcctgtggcatagtaattgccaagtcttttgtcttataaatatcttgtgccaactgatctaattttttcaattcggcatcatgtctaaaatacacataccaaatgccaaccccaacaatcactaaaaatacaacattcattattagttcctactttcttatccgtactttgcttcaagctccgcaccagcgttcttatcaactgtcttaaaggctttcgtccattcttcaaataacgaatggataaccaccttaccgacacgaccataaatatccctaaacaaacattgaccctttttcaggtcttttaacatatccatatttgatttattcactggcaaaccaaaatgtcgcaagatattttcacgctcactatcatcagcgctatcaaaggcaaatatttgtccatattgaccgttactcttttcatcattgacatcaccaactctttgagtggaatatatcagcatattgttttcagaacgacccaaacgcttgatgccgtccaagactttacgtccagcaggcgaagcgttaaatatccacgcttcatcaataatttcagcactaaatcgtttcgtgtcttcacgtccaaatttttcaaggtacttacctaatgccaacataatcgataccgaatatttttgtgtttcagtgtaactacgtacttcttgttcagcgtgtggcaagtccaaacccgtcacttctaaaattgtccgttgattattaaattcgatactatccgtttgtccgttactaaaagcaagttttaacatactatcaggaatgacactctcataataattcgctaactgttgtgacttctcattgccagcttttagaatttcgataatcgccattgtaccaacttgttcgcctgctaatcgttgattacaaacttgcttaattgcattcgtcaaagccgtatcaagttccatatcttgtgagattgaccgaacttgtaccaacatttccttaaccaacgtcaagacactaggtatttcatcaactgtacttttactgttcaaagtaagcattgggtcaagaacaccacggttagcactatcattggcattcaaagtcacataatgaaatgaattcatcagcttagtgaaaaacgggttttcattatcttccaatgatgctttaaaccaacgtctcacttcttgcttagggtcaacgtacaacagcttgacatcgaacatagcaagataattcaacagaattttaactaagaatgactttccttgtccggtatcgccagtgatcgctatgtgtggactatctgttttcgccccaacaattcctttgttggcaatcactgggttgattaaaagcaatgttcttgaagatgccacggcgctatcgacactaaagtaacggtttgtatctaacacacgtccaatataaaagccagttcgagaccctaattcgtgactagtaccaaacatcaactgggctagggctggcgcattggtaaattgtcgccaacgtttaaaaacgcccaaattagtcgctggcagattttgatacaacaataattcttgattaaaactaggttgaaaaacttctatttcacgactaaaggtagataatcgtgttttaatttctctaatcttagtttttaattgcttaacatcatcatcacacactactagaactaacagccattgcataaaagcatctttactatccataacatcagccaagtcttgtgctaaagcataatttgttcgagaacgctttgaactatcatcatcacttgacaaggcatcttctaattcatctttgtactttccttttgaacttctagtctcttgtttcattcctttaaaaccgtcacgttgtggaaaattgattttaaaatgaacttcaacaggaaatttaaacgattgtaattcaggaataagcgctaaattgtctagtctatcaggcaaattcaaaaccaagtgactaatatagtctgtttcttcctgcgtttcacgtttgacaatacccaattttgctaaatcaaaagccgtatcacgcatgttagaaaaatctttcattccttgatgatgataagttgagcctaacatattgattaacttttcttcggacattttaacggcatctagcggtcgcaaaataccaagtacatcatcattcatagtttgataacgttcaaagaatttgtcatcaaacttgacctgataacgcatggtttctgccaatctacgcaagattaaatctgtggcaaactggaacttgtcttttaagtcgtccccaacactggtatttttcaacttaacaccaatatagaattcatcacgaattgctggcttaaattcactttccaaaatatcgacttcttcttgacccatatagtattgcgccacatcagctatatcttttgcccaatcaggactagtgccttgaatacgccccgccaagtccatatcaactggaaccaacttcaaatcaacatcatcatatttttgtaaacgctcaaacacatcaacaaatgtttctttaaaattacttttgtcttgtgcattagcgacattgatttgaaatggcttcaactgataataagcccacacatcaccgattgttgtgaggagtaaattgtcttgatactgcacaactgggttttcgtactttacattgacattctttgccatacttaatgacctacctttcttttaaaatttgtcattgatcacttgcctcggtctctgcaaaattgttaatttgtttcacatcagttgagacaagtttcatgtttgggttattaggtttcataaacgttggtgtttcttgtatcgcaaagtcagtcacataatgcttgttattgacgttttgcacattgattgtttgaatttgtttgtcatcatgattaaaattcaaaacattgtgccaaaagattttaggatagaccttttgacaatgtgcgcaatcagagttgtaaaacatcacagcctgtacatttgtatctaacccttccacatcattattttgaaaatacattgatgctctcgggataaaataaaaaccagccactaataacaaaatgactggtaatacgctgttgataataattgtaattggtttggataactgttttttattccctttcttagtctcattaccccctttaatataatgtttcatcatttgttctccttactgtatttgatttattttaattgatgttagtttctgcgtttttatatcaaaccagccatgtaaaagaacggtttgattgattgctttttgacctgtaccactggtttctacaattacagtcgctagactttcaattgtttgattatctaaatcacttgtataacctgtggctgtttgatactcactagttaaacctaaattatcaattcgtgacccaccagtggcatctagtccgctatcaaataatttatttttttgtttgcttggtagacttaaaatatctgatacttgattaaatcgcttatcataatcagcttgactactaaatgtataataagcctttgcaaattctaataactttcgtttagctgtcgcatcatttgcattgtacgtggtttgtaagttatcaatttgtgtcgtgacatgcttttgaagctttttcacttgcgacacttcctttctaacttctgctatctgtgaccgttcatgatttgtgattgacaatgtgatgccaagactaactaaaaacaaacccataatgctaagtaaaaccttatttttcattatcgaatgcccctttcaaggttagtcgtgacatatcagtcacttgcttttcatcagtatcataagttattgtgtaagccacactttgtacatcactcttagcaataactagatattctaaatcagaaccccaagcatttttaagcccgacaagtggtacatcataatgtgctttatcactaaacgtcacactgggcgcaaaagtttgagtgagttcgttaatcactttttgtgatgccaacccttttaaactatcaggataagttgaagtaggctgattactaaatgtcttaacaaaatgagtgacttgattagtgctatcactaactgtcgattgttgtgattgaggactagatacgattgtctttgattttctttgacttaatttagcttgctttaaatcagctttagtttgtactaattgcttatctaaatttggcatctgattaaactgtgtgataagaataccagccaaaactaaacacgtaacaatgattaaacggctatttttcatactatctcctttcgattatttaccttgaataaaggttacgtcttgacctgctgttaattctctaaaactaaccgttccagtcccagatgccacgacattacattcactaactaagaaatgcttaccgtcatcactgatcgcttcaactacggcaacgtgtccgtaagtcgggtctgcaccgtctgcaccttgtgagaaactaactgcccaaccaacatgtggctgactatcagttttataccctttggccttagcgtttttgccccaatcagccccattgcctaaataattttccactggtgtgcctaattcctgcatacgattataggtgtaccaagtacattgtccgaatggataagtatttgatgatgaagtagcagtaaagttcgtgtccttaattttgcttttataagcactgggaatttctttaactggcgcaccactagtccccataccttgcgcaacattagttgagcaaccactggaattattagttgtattgtcagtattttgagttatttccgtaccagttgtggctgtatcaacggctgtatctgatgacccattggaaaacttagcataccaagaacgagcatagctttgtctagtagctgttgtcccagcaccaccacgttcccaactagctcttaaaaattctgtggcatcatcaatgttagtcattttcagaccttgctttaataagtcggagtttgtgccatcatgattaagcgcaaaatcatactgcacacctgcatcagtccacggtttatttttagacttagcataattgattaactcaacacgccttgaattgtcccattgattaagaccaaaagcgtaaccacttattttagggttcatggcttgactttcactgtaaggcgcatttgattgtatcacgctagaattaaagccactctcatgctgtgtattgcctaaataacctgcaatgccagcttcggtcacacccgatatttttttgagattatcatgcaaggacttagcaaccgcttctttatcagcactagttgtgatgttggcatcacttgtcgttgattgacactgatcgctgttaccagcaaacataccaataatgacaacaattaaaaaaacaagggatagaatagctattaaatagcctttcagaagttttttcatcgcaactccttatctaaatcttgcttgttttgtttacgctgttcattatcagcttgtaaacgttgattaaaatgtgtggtatcatcttttgacttcaatacctttgaacgtgcctcacgtcttgtctgtgcctctatagaaccggtttcataacttttacttggtttacgtcctgttggctctgtggcgctatcagacgtttcaggcactttctttaattcttttgaacgttgatagcgtggcaatttcacttcatcagcaattgctctactatgtgtaccgttattatcaggcaaatcattgccccttgactgtgccgtgtcatgtggtgtatcttgatttggcattgcattcttcaaacgactagcacggtcttttttgacttgtgcttgatgttttgccatatcctttgaaaggtagtctttgcgagcttgcttacgctttgcttgttcttcctgttcaatttcatcacgtagcgcatcatcatcaaactcaccactatgtttgtctttgtaattgtctttcatgtctttgccacgtttgataccgttacgtgcaccttgatacatacgattagcactattacgcatttcatttgccgtgcctagtgccttacgtcctgccctagtcatactaattttgttcatagcactattagctacacttgaaccagtaatcgtttgcactaaccaacttttgtttttccaaagtaaaatcatcaaaacaatataaacaattgagtttaacattgaactggcactatttgttggtggaataacagtatcggtcacattgccaacccaactaataaacatgatgccaaataacaaaccaaccttagcaaacagtaacccaagcgctcccattgcagtttttaaagcactattcgcaaatttaggaatgagcgagatcataattgtaaaaggcgctagataatacattagaatagcccctaattgaacgagcaaattagccaacccaatcatcagcaacggtacaccataagcaactgacatcactggcgacataagcgcaatagcaacctgataccattcttgaccgcctttctttttaatatagacatttttataggcaaactccgagagcgtactatcgtcaacattacccccaattaaacgataagggttgcccatttcatcattatttttttcagcatcagccatagttgccaccccataattacctaacaaaaatggtctttcaactgcttttgtaaaatagttatagcgcaaagtagcttgaaaactagtacctgtatcagaaaaactatcattatcaatgttgctagttgccacaaaaacagcagtttgtgcattagaagttagtgtgttgatagttgataatactgtactaccagcaccaacccaagcagaacctaaaatagcaataaccaataacgtgagaattgactttaaaccaccaccgcttttaatgcttttagcaaacgtccaaaccaaaccaacaccaaaagctaagtatagcaaccctttcattgcatcactttgccaagctttttgtgaatactgcccgacactagttaatacattattgataccagttgtaatgccagttaaattgaacattgtagataatgctttatcgaacaacggataaacaatatcgaggttgattgcagtaaacaaatcagtagcaatgtgtgcggcacccgatgaaaaatcagttaatgaactgtcttgatgatagagcttgtagttttttaaaatattactattgacccaatccatgtcaggttttcctaattctgctttaataacatcttctgttttagcaggcgcacttgtatttgcttttaaactgtttgtttctttaacatctttacccaaaccattcttaacatttgtccctaaactactttttggagtagttgtacttgatgaactcttaccatttttttcatcaactttttgttttagtggactactgttagcgttagcattaccgatattgtctgctaaaatctgtgtagtaggtacaaaaaaagcagtcccgactagaactgccaaaccaagtataaactttttcatttataatttcctttctaaaataaaaacacctacaaacaatgcaagtgcctatcatttatttaactgtgttattcgtccatgtataaaccaacggctgattatcatagtataatctacctatattgccgtcaaccattttctttttgcttaaatcataagcatttatcatagtcggttcattatttttatatccgtttttatataacttttgaacaataacgttgtctgacttattataaaaaatttcaatcttagccagatttccgccatcggaacttgtatccatatcatcatcataattattaacaccagtagctgtcatagcttcatcaatacttgacttagcaacaataccgtcatttgagtatttaacggtgtaatctttaccctcaacatattgcttagtcgatgtgctagatgaacttgatgcaccattagacgttttaacagttacacctgtttctgcggttgtagcacccgaatttgaacgtgtcatcaagaatactaacaaaataagaataactaaggctagtcctgcaatcacaagatacaatacattctttttattaaacttttgtggcttttcagacatatcttttctcttatattgtgttgttaatatatccattctatcacaccaacctttctttatatttgtaattttaaatgttacctgttggaactgccccaacactgtcctatcttgcaactgacgataacatgataaaaacatgctttcacatgtttttcaaaaactataaaatttgataccgcttattattgctattcaaatgtttatcctgatacaactgtttcttttgaaaccaataacgccaataatgtgttaaagcatattttagcgttgtttcaaatggtaaatcatcaactttgagtagcttgtctaattgataaacgccaactaaagtaccaaccaataaagcaaacccccatgttaaagctccattgttcacagtataaagtttgaacacaaaaataatcacggcatcgatcactgttgtgattgccaaaactccagcaattcgagtatcaataaaaactggtaacttgaaatcgccataaatcgttttgaactttgccgagttagtataaacccgtctgtaattgtacatacaccttaaccccctagaccttgaatataattcaaaattgtattcatcaaaccagaaaaggcatttaatgtattggctggtccgttgataaagaaataaaccaaaccaccaattaaaattgtaacccacatatcttttgtttcgttcttaccgtaatgtccgattgcccgaccaccagcgataacaacaacaccaaaaagcaacacaggtttcaaagcgttataaatatccataatactcctttctacgcttgtacaaatttagtgacaaaataggttgatgactgcttttttaaatctaacctaattgtctgtacttgcataatgtttgtaccatgaacttgaaccgtcattgtcgctgtcacaactggattttcacttgtgcctgttactttgatactactatcatctaacgtcacaaggtcaacagccccatttagccccacagggtcagacattaacattgacatatctttagttgaagatgatacatatttttgtgcaaattgcttggtaaacttaacgacttttgccgtgacttcactatccttgattgtcttaccatttttatcaaatcttgcagtccctatgtgtccgatactatcaatcgtgttagccacataaggcaaaccaatcacggttagtttttcattttcctgcgcatacggtacattaaccgtcatatcactttgtttgccgtccgattcaaccactaagctatactgtgctgttttgacactatccacagtaaagatgccatttaatttagcactatctaacttcattttagaattatccacattgttaggtagtgtgatgttacttgccaaatatttgcttaatttttgggaacgactatcagcgttgctatctgatgacgaataataaagtgtcaagaagttggcaagatattgtccgacaacagggttgtaactggttgtaccagcactggctttatccaattttttgcttaaagttgtgaccgttgcacgcaacgttttattcttttgagcgatcgcattagccagtaccaatacataactaaagtaaataaaaagtcctattaaaaataatagaactatcttacgtaccttacctaaattcattgtatgagctttaggtatttttgttgttttttccttttgctttctttcatactcaaaattcactttgagttttgggagaccacgcatttcacaccccctttcgctatttttacatcacattattaaatttgcttacgcttgtaaatcaaaccacccaaagcaactaaaccagacattgccaatgctaagatgccattaccacccataaatgacttttctgtggcatgtgttaatggcaatgccttagctacggcgtcatcaagtttttgcttggcttcaacaactggtgcctttgtcgcatctttgtcattagccgtcaatgcttgattataggcttcaactgcacgagcaacgctaggtacactagcaacttgtgttggcacatcaacgacattacctgaattatcaggtgttacttccactggtttaacgttgttgacttcgccttgattgtttgtatcaggcgttgttggtgttagtggaacggtgttattgtcgcttgatgacccattgccaccagtcgttgaactatccgtaccgccaccatttgatgatgaaccattgttatcacttgatgagcttgaactgccattatcagatgatgaagaactgccaccgttatcactagatgaacttgaaccgccattatcagatgaagaaccaccaccattatcaacggttgtaccgtcatcagttgatgaagaaccgccaccattgtcacttgatgatgagccaccattatcagatgaagaactgccaccgttgtcacttgatgaagaactaccattatcagatgatgaagaactgccaccattgtctactgtggtaccatcattgtttgatgccccaccattgtcaacggttgtggcgtcatctacagttgaactggcatcactcacaacatcagtattagcacttaatacaactgccttaacttgtggcaacgccttagtggttgcttgtactgattgtgctgtactagtatcagttgttgtcggtacagtatcagcactgacagcttgatgacctaatgccaacgcacccagcacagaccctgcgattaaaagttgtttttgcaacatatttattgtctcctaacaattttattgattgggcttcacaccccatttggttatatgctgtgataacgtcacgagatcagtttttagattagttttgctttttaccttttttagagataccaaaagccaaaccaagactagctaacccagccaatgcacttaacaaaacaccgccctgaccttcattagcgttggtatgtggcaaaatacttgccgtttcaactgcctttggcgtttctgatgtggctgtcttctcaactttcggtgtcttcttaatgttgtaataatgaacctcaaccttttgtggttgtggcttatcagcatttggcatatccgcaacggttacctttttaacactagcaactggtacagcaggctcttgtcccttagcaggtgcgacaacttgtacatgatgtactgttgcttttggtgccgtaggcttcacagggtcttgctcataagttggtgcctttggtgctacattggtattcttaatttgcgttgataattgaccatgagtattccatatccagttatcatcaacaaccaatacctgtgctaaaggactagtctcatttggtgagattttgaaagtcttgttaatttgagcagttttattgattgactttgagaatgtcgtattgccgtcatggtaaaccgaaaatagttctttaccgtcattgtcataaacgtggaagttgatattttggttaaccgcttggttttgataagcattagtatacgtatatgaatacagttcgattgatgaaatcgtcactgtttctgtcccgtcaccatttgaaacaatcttccaattaactttacctttcaaaacaccatgaccaatgatatgcacaccgtcgttcatatcgtgttccaacgtaaactcacctgttttttgatcaacggtggcattcataaaggtttgatattgaccagatgaagcgtcagtttgcgtttgagctgtcatgcttgtcgtatgattagtcccattcatgtactcttcaagggctttttcataggctgcttttttatcagcatttaccttatcaacggctgctttttgtgcttcataatcagcgacttgcttttgatattcagcagttaatttaacgagtgttgcttcatcagctttttcagttgacacaccactaactactgctttgttatacaaatcaaggttataagccattgcatctaataaatcttgaccctctaagccagtcaaatctttgtactgtggcgaaacctttgaaacttcaacactcacatcaagtcctgcatttttgcttgcttcaacttgcttatcaaggtctgatgtcgcattgttcaaatctgattgtcctttttcaaccgcttcatcacggtctgcattagctttggcgtaatcagcttgcttttgttggtattcagccgtcaacttagccaatgtttcagtatcagctttttcacttgccacaccgtctgcgattgcttgcttatacaagttaatgttataagccattgcatctaacaaatcttgaccctctagcccagacaaatccttatattcgggtgaagattgtgcaacttcaacgttgactttgataccagccttttcactagtatcaacttgcttatcaagctctgatgtggcattatctaaatcagcttgtccttgcttagtggcatcatctttttcagtagttgctttatcataggcttcatcatttgcctgttgttttgccatggcatctttaaccgcttgatcttgcttattcaaatcagacaatacttcatctgtttttgatgaagcgttgtcatcggtaactgtgacatcagttgtcttgccggtcgtcacatcaacaccagcatcagatgcagttttagcatcatctttgactgtatcttgtgccttatcgactgcatcagatgcttggttttgcgtgacacttgtaccggcagttgttggcactgtgcttttttcagcagttgaagaaacagtcgcagatttagtggcatcatcaattgtcgctttgtccgtagctgtatcagttgatgaagcagttaattgaacttgcttgtcattttgcgtggcatcagtggttttaacagcttgtgcatcagtgtttgaaaccgtatcggcactgacttgtgtagtgttagcactcacagcaacaccagctactgcaaccgccccgacaacccagagcttaccagatttgtataatttatacgtttttgaattttgcataattgttaaataaaaaaggctacttattaagtaacctatcctttctctcaaatattcttttgtaattgattgattaaatgtaaacctctaaaggttctttgaacgataataaataaaaaggtcaaaacactagcaattatcatagcgatatgcagtgattgacccaaactcataaagagcaaaaatatagggaaaatagacccaacataaacgagccaaaccccaaacaaaaagctaaaataaatcattttctgtgccattgtaacaactaaaaaagaccgattgtttaatcagtctttaacctttctcattatatcttttagtgagcgcaaatagatgattctttgtgcgtcaaaattaaagattcgtcatgaattccttgaaaaacaagggtgattgtttcctttggatgattttttatatttttccaaatggctgttgtttccacaacatctccttttttaattgcttttcttgatactggtttaccgtgatcgtgcactatttttaaatacatgctaatctgattacttgtgtaaggtttatcagcggaaatattatcacctgctaatagatcttcataatctgttttggaccacttttttttgttaattaacttcgattgttgttttaactgtatttgttcttgttttctatggttatttattaaaatggtggtgctaatcacaagcattacaataatagtgccaacccccaattttttcttcatcaaatattctcctgtaattaaaaacattattccaaattattgaatattatttggatcagcatttttatcgtgtttttcaataaaatcagcaactgtattgaaataaaaccaacgctgttgtacaagcgtattaaaacttaagcttgactcacccgcattattattgattttgatattatcaaatgtatatggtgtaccaaattgagctttcatattaattttatcagtgtaactcaagttttgatatactgtgatccatttttgaaaatcatatagtgtccatgttgtaaaaaagacgtttgatgaattattcccgtgcatcatatcattcccatagggaacagaaaaaacatgtcgttgatctgtagaatgttggatatccttatttaccacgctttctgacaaacttgactcttcagaagtaatgcttataaaggcaggatgtgacatattttttgtttgaattactttttgaccagttgtaactaataaaataattagtagaacaaaaacaaaaatcaaaagaacataatatcgtctatttttcatgaatacccttagtttttaacgattaatttataaactatagtatcataaacaagataagaggtctattttagttgtaaagatgcacagtctaggagtaggtttataataatgtcgttccttactaaactactaatttttagttttattaacttgattagtagctgtcttattttgacttgatgttggcttttctgttgccttttcatcaagtgcaactaacgtgtcagcatacactgtccaatcagttgcatcattaccagcaaatgcaaacttcaaaccttgtggcactaacttgtcccccggcttcaaaccagcttgcaagcgttcactttctgctgggtcaaccaaaatacggacaatgttatcatcattgccaacatcgcctgatttgctttgttgaataaagttgaactgataatttgaaataattggttcatcgtaatcatcacgtgcaacttcgccacgattatcagttttataattaggtgtaaccctaaacaaaactaaatcatgactatcaaacgcatcagcactacggacacgtccatgtggtgtcttgtctttacctgatacgaatacagcatcatattcttcttctggcaaaatgtctgtcttagcatcagacataggtaacaaagttcctgtcttagtggcaacacgagcgccatttctttggttactgcgagcagtaccagcaataatttttgcatcgatcagttttagtggtgtgccaaaagccatactaaaatcaaagccagcctgtggtgtgacattttcagtattcaatgtattattcacattcaacattgccactgctacatcagcatttgcgccaactaaattgcgcccagcaaatgtgagatttccgatactttttccttgtagtgataaactaccaaacttattaaccataatgtaaactctctactttcttaatttaaaataaaaagcaaaaacgctatcgttttcgcctaaatcgaactataaattcatttgtttttcggttgtaaacaatctcccaataccctattctattggtattatagaaattctattttccaattgcatcttatgcaataaatttttcccctgagaactattcgacatagactgcccatattcagccattaacttgtaaactctttcgtactgttctgaacctctatctacatcatcataattagaataataaaaaaacaagtagacttcttgattataaatatcgagttcatcaaaaattgactgaaaataagaataatctgcagaaccaagagagtgaccataaaatttaacaactttgatattcttatttatgaaagaacctctgtcaatactgatatccttttttaaaaataaagtcctataagttttcgtgaactcaataattgaaaattttaaattatcatcatttgataacaaagattgatcaatacctaaaattagattagatttacctttgtcaacaggtgtcagttcgccatgaacatttttaacaactactggtaaactctgtaacttattgtaaacttgaatgggagtatagttaaaagtcaaaaccttaactttatagtcattcctactaactccaagtttcgctaaactcaatagtttgttttcggttatttctgtatattcttgattactattcacttcttgtgataaatattcattaagaaaattctcaagaatatttaattcggagaataaaaaattcataatatcatcaacagtagaaaaatatatattatttctatttgtaactatcaagggcaaaatattgtctttgatagttgctagtgttccatcttcttttggcaaacaaattttatgggatttttctactatatgatgatgtaagctggactgttctaaaccaaaagaatctgtgtaagtagggtttgaatactcatctttttcaaactcagtttgcaaatattcaacaacttcaccaatttgcttttcaacatcaaaccatgttggatctgataattgggccttttcaaaaaatgaattccaaaaatttttactccaaatagtttctttttctatgttattgttattattcagccacacaaaaaaatcttgaaatgaactctttagaccattatttaagtcaaacccgttaccaatgataattaattgttcttcattttgcatacttgattaatccaccactattttacaaaaattatactctttcacatacattttgaaaagtacagttttttcagatattaggtacctattaaaaaagtattccaaatgaaaaatctggcacaatgctcaacaaaatataaaaatcaaatctctttatatattaattctttcacactttttattttgcatcgacacagaacctttggtgtattatatatgccactaaatattatacacatcgcatcggtactgtgattttttctaacggagtaacaagtcactttaattacagtaactgtcctagacttttctctctacactcttttagaggctccgagttagctaattaaaagccaaccatgattgctataattcacaaaataccttacaattatcttattgaagattagttaagtaaatttgattttttaaattaacgtttccagacattatttcataacaatcaatttttatatctagttttcaaagtacataattgactagccactggctggtctttttttgtgcctttttgtatctttaggtcttcttaataaaatgagcctttttgacaaaaatataagcacaaggtatgttacagaagtatttcaactcctatatcaaaccttatgcttattattctacagactccggtcaacccaagcaccacatgtttaatgttctggtaatctaccggtaacttctgtgtaaaataaacgatgattattttttatttaaggcacaacctcatcaagaataacatgattgtgtttaaaagtaaacggagcgtccacgcttttggaatgtctatacaaaggcttttagcaatctaattactcactattatatcaaatgtttcaaccaataaactagttttcaaattgttttattttaagcacaataaaaaaagacacaacccgtgtctaaagtttattatctttatgatcaattttaatgccttatttttcatcattttggcgttcttcgagcattcgctgtttacgcttttcataggctctacggtaacgttgcatggctttatattcttgtgcaaagactaccattggtcgttttccattcagagcttgtctaagtggcatggcattcatttttgaagccacttcatctaattgtcgttgcttcacgtctttaaaagaagtgcctttaggataccaatcacgtaacttacgatttcgattttcattggatccacgttgctgtggtgatgacggtgtggcataatataacttgatttttagttgtttctggacgtactctaaaaagtcccatgatataaattcagaaccattatcggctgtgattgtgcgaaccgctttaccgtaacgttcataaaacagcttaaaggcatcaatcatgtcactagacttcttactacggactaatattaaggcggtaaaccgagtcttgcgttcagtcagtgtcataattgctgtggtatcttgataacgctgattattcattttagctggcaacactaaatcaatttcccaatgaccaaactgtttacggctttccacaacttgtgaacgatcaaatattgaatgacggactaattctccgtcattttttagttgctcacgcaaacgtgcaatttcacgttctttatcacgtttagtttgtgccacagctcgttctttgggtgtaccattttgacgatgatatttctgtttacgaatattgataagtccttgcctagaccataacctgatcactgatgcagaaacatcaacatcttgcacattaccagcaatttgctctggcgtccaatgttcaacattaacccaagtttcaatgatctcttttaattctggtgtcagtttgagaccagtacccattttactgcgctttttcaaagcaatatattgtccacgctgtgccgaatacttgatacgtgcgtgtatgtccatattcaacagtgttcgtcgatctaaatgtgagaaatcaagcgtattgccacggtgtaattcacgtagtattgatgacggcgtatagcctaaacgtcttgcgatatctgcttgtgtcattttctcaatattccacaaatattcaatcatgtgacgttggttctcattcaaccgtggttgtcgtttgcgtttttgtgttgtttcatcactcataaaatatatttgctccttaattatgattatttttagtttaggtatttaccccttataacaagtttaacatttcacaatattgcttattattttatttttttacatacaatatattaaagcattaagcataatgaagatttgggttttgaaattaaataaaatgaccctgaaaatttttccagagtcgtttctcaattcttgatgcttacttgatttcttataagttgtgtatcattttgactcgctctgatataaataatatcaccagctcgcaatactaagtctccttttgggattagtacattttcggatcttctgaccagtgtaatcaaactatttgatcccagttgtaagtctcttatttgttgatcttctaaaataccacctgcaagaactggcacttccgtagttgtcatggaagacatcgttagatgcactggttttctttttaacaaacgttctagtaaagattcatatattggtgcaccatttaatagatcaactactaagtaggctactaaacttacaagtgctaaaggtaaaatgtgggtcacactccccaccatctcaaaaataagaataattgcagtaaatggtgctttaccaatacatgcgaaataaccagacataccgatcacaataaagttcaaagcataattggcactcatgagatgtaaatagacaaatatatgagccatcaatgcgccacttagtgcacctaaagtcaaaataggtaaaaagatgcctccaggcagaccggaaccgtaactaatcattgagaaaacaaatcgaactaacaaaattacgatgatcattttcattgtcataggtgtttctttcagcgacaaaattaaattattgcccccacctaaaagatttggccataagattccaattggtatcaccaaaataaacggcacaataccgtataaatatttaggcaccttaattttactgtaacaatttaagctgaatagtaaaactttttgatataaaaagccaaataaacctaatataataccaaataccaacaataagccatataactctaccgggaaaacacttaagtgaccaacagataaaactggtgtttggccaaacaaaaccgtagagacaaaatccgaaatgcttgcgcctgtcaatgcaccaacccagacaaagggagaaatactgtgatagacttcttccaatacaaacataacgccggctaaaggtgcattgaaggcagctgataaaccagcagcggctccactggctataagtccttttgattgattatgactaagatgtttatatgatgctacaccctgaccaattgatgcacctagttgaattgagggaccttcccgccccagcattaaaccactaccgatagctaaaattcctgatataaattttcgccataatgtcgaccaccagtttatttttagttcacctaataatagcccttcaacctgtgggatgccggaaccggatatattaggctctttgtttaacatccatgcaacaattaaaaagcctataaaattggctatcatcaaaaaaaatattggcgttatattgccatgtgagatatctatatacaacgcttgcacaaattgaagcaatttttcaattgtccatcgaaaaacgctaacaactattcctgttaaaaaacctataagtgcgccatataatactactgacagctttgatgtattgaatctaattctttttttaaacataaaatcagtgtacaacaaaaacgagtttgattccaagcataaaaactattaatgtttttcggcaagttgcctttttgcttgatacaactgttcttcaatcttattcaacccactttcagtgtttcgatcagttcccttaatcaacaagtctaaatcacgatacgcaaaggttaactcaattgattttgaaaccaaatcttgtaccctagatgctaattttttgttaaaaaaaagcacatctccgtatgtttgagattgtgcttgtctgattttttcttgtaattgcattgatacgctcaacgtcgtttgaaagttgggcgcaccagctttgaattgaaagccttgtctatcactttctagtgtttggtctaattgactatataagtctctaaaacgttctaactgtttaatatacagctctaattgttctggcgttagccatatttttgttaccataatgtttctccttttcataaaaaaatataagcatctagaaacgctttcaaataactgcaacaactgttgctataaattctggtctttgctagagactcgaacattagttgactctagtatttttaatcacctttattttgtttgaaatatttaatatcatttgcaattttcgaaggtttgccagttctattaaaaagtatttttattggtttcgcaatttgcaaaaacattttattcttcgtgtaaaaagacagccgtatatgaaaataatttatatattccaaaataagaaataaatacaaaaataattgtaataacatttcgtaaaagctggtaacactagaacaatatatgattagaatagctaaaaaaaataatataaaggaattaaagattttaaattgattatacaatcgcccaaccttccacttttccatcacttttttgccatctatttgtttgagcatatgtttccaataaaatgttccttgtaataaaataacagataatgctatcacaatgaaaaatgtggcaaaattgaactttgaagctttaacccacaacaaataagttgtaggaaacattatactactgaatagttctccccaaaaaagtgattttaattcatctcttatgttttttcttttatacactttctcacatccttaattacgtaatcttatgaaacaaatttaccatgtaaactaactatgagcaatcattgtgtcaccaaaatctctcaattaccacttatattgtctatctattccactctcatcaataattcttaacggttcgccatagatatgctgggtactatgaccaccagaagtccgtctaggtgctggatactctttttgtaatttacgcatcacatctgctaaagtattacctgtcatatactcgttttgctcatatgtcaataattcggaatggtaattactgcaacgttagcttgagatcttctgctttaatcatttttaacttagtcatgaataaccattttaaaactgtggcgataataacaggaagtatgacaaataccagcagaatgctgaatatagatacaagacttttgtctgattccgaccaagccgtcaacggaccgactaatccagagaatccaaatcctgcggaaaatggcgtccctttgatattcaacatagttgctaccgcccccattattgccgcaccaatacttgttggtataaatagtttgggtttcactaacatatttgccatttgaatttttggcgagccaacaaaatgcgccaacgtaccaccaatgggattcacactagcgcccattaacgctaatgtaaaacttgccactgtaattcctgcattagcagcgcctgatccaactcctgccaggctaatagccattgcaatacctaccgaagataacggggaaacaataagaaaagcaaaaatcacccccaagaccgcgcccattactagtggtgttaattcagtagcataagcgacgccatcccctatccatgtttgcaagacactgatcggctgtaaagtcatcagcccaataccgccggcaataaccgctacaaataatggctgtaataatattttaaaatgtccaaaagatttctcagtgaacttcaccaatatagatgccaaaaacgctacgagcaaaatattgagcatcacaccgctaccagaaatgattgcgccattggctgtgcttttcacaacaccagcagaaacaaacatcgaaagcgcgatggcgcctgaatcaattactgtcaattttaaaatttgacccacagcaaatcctgctactaatggcaatgtactttgaatcagtgtcgtcataaacgcaatctgggtagcaatttcgttaccagaaaacaataacagtaattgactgaccaatgcactaggaattaaagtcaaaactacacccaagctcgtaccattcaatatatcaataatgaatttttttattgttgccgcggaactatttttaactgatttcatatttctttcctatgtatgcgccgaagcgcttaatttaaacttcgtgtggtgaagattgtccgtttagtatcattaaagtatcatctaacgaaatgtcaaccatgttcttgacggctatgttagtaaagaagccaacatgtggcgtaataatgacgtttgacattgataatagtttttggatgcgtgcatcttgcaccccctgatcatgtaaatcgtgattgaaaacaccggactcattttccaccgtatccagtgccacggcacccacttgaccattctctaaaaaagtaattaaatcacttgtgttgataactgggccacgcgaagcatttattaacaacacaccctttttcatttttaggaaatccgcctcagaaagcaaatgaattgaagtttcatttaaatcgacatgtaaactgattacgtcactttgtgccaatagctcatcttttgtaacgtaggtaatcacatcacaaagtgaagcatcgcggtctgtatcgtaacctaagacattgacaccaatactatttagtagttttgccaatgtcccaccaattcgtcctacaccgacaatgccgatagtaacagagtgaatttctctcgcttgaagacctgtccagcgaaaatcattgttagcaatccgtttgtcaaattctggcgtatgacgcaataatctcaggatctgcataagcgccatttcggctactgatcttggtgaataggctggtacatttgttattttcaaaccagcttttttagccagatcaacttcaatcatgtcataaccagcagtccgtgtcgctatttgagttatttgtttagcaatatgatgataaaattgttgatccccaccaatttttgcagtttgttgtatgactaatccgtcaatttctgttaaatcaggtagtgtttcaggatggaaatcatcacgagaaatcactatttccacattattcttttcagcgtagtgacgaatagcctgctcttcgtcactacgcacacttgtcatcaatattttattcatttaccattttcttccatataagcagtcaaacggtgcatagctttttgcaatgtttcaatggatgccgcatagcttagtcgaacatacccttctcctccaggaccaaatgacgaacctggaatcaaagctagaccattattttgagctaaatcacgagcaaaagcaaaatcatcctgaatatagccagccggtattttagcaaaaatataaaatgctccatctggtttagcaactttaaaaccaagttgtgtcattgtgtcatagacataatcacgtcgttgaagatactcagccttcatgactaacgtatcttgccgccctgcctctgttcctaacgcctctgtagctgcagccatagctggattagaggcagttgttgttgcaaattggtgaatcatcgctattttttgaaccaattgtgctgggccagccaaaataccaatgcgataaccagtcattgcatgtgattttgaaacaccattcagcaaaattgtttgttcaggcaaatatttagccattgatacatgactattttcatatgatagctcagagtaaatctcatcggaaataacaataatgtcagtaccacgcaaaacatctgcaatcgcttttatttgttcatcattgtaagtaaccccagttggattagatggaaagtttaatacaacagctttgatatcatccccatgcttggcaattgcagccttgagcatctctggacttaacacaaaatcatttgaagaagtgtcgataaatactggttcagcaccatctactaatcccactgctatatataatggaaaaatcggtgtagggagtattattttatcccccggatttaatatagttgtgagcgtatcataaatagcttcagttgcccctatagttacaataatttcgttagtaggatcgtaatcgatatcataacggtctgccaaaaatccagccgcagcctcacgtaaatggatcgtaccatttgatgcagcatagtgtgaatcatttgcttcaatcgaccgaattgccgcttgtttgatgtgatcgggtacattaaaatccggttcccctaacgtcagcttaataatatctggaatctcactcacctcaatatcaaatgctcgaatagcagatggaccaacaagtttcaaatgttgattgagattattcaataacgagggttttacttctggcataattttctccctaatttaacacaaaacgcacatccagaaaaaattctgaatgtgcgtttgctcaaatgtagatgaactcactaggcattcagagggttaatccgaatacctacgcaaaatgccttaagtacttggatagttagccaaaatacttaaagtaaaaatttgctgtagttttgttcattaaatgtgacattgtgttaaaaccttttttatttttatgagattaattttaatattaattccatcatttgtcaagtttcttattaacaaaatcacattttaccttttttgggaagactacggccgctcataatatcattgacaagtagatcgagacgtactttagtttttgcccaatcatcgttcgctagttcgtaggcaacattcttcagttcttttggcaaagttacgtcgcgtaaaaattctggcgaggctattcgttgttcaaccactaatggatcatctcctcgaacttgcacgcggtcaattaacatatcaggatgcgtgactgtaacgaaaatgattacagcttgttcacctagttcctgagaatacgtaatagcccccgcagtgtccaagacaattgttgcatatggattttttccccaagcgcgctctaatgcctcgtatgatgagccgtacttatacccagcatactgcacccgttccaaataatgattcttttcaaaactattatcagtttcaaaataataggctatgccgtcctcttcccgctcccgcggggggcgcgttgtatgcgttaaaactcgtggcatccgatatgtatcttgcaaatagcgggcaattgttgtcttaccgacacctgtggcaccagtaattacaaaaactttgttatttttcatcattcaaattccttagttattattgtatcgtaaaactatttataaagttcgacaagtatacttgaaattgataaaatagctggtgtacaaaaactattaaaaatgggagaactattatgtcacttcttgcacgagcttttaagcgggaatctgttgataattacctgagtgcagattcacatatgtcgcgtgttttaacaacgcgcgacttaattagtctaggagtaggcacagtcattggtacaggaatatttattttacccggccacgaagccgctgatcatgcaggtccagcagtcgctattgcatttctaattgctgcaattttctctggattatcaggtatggcttttgctgagttctcagcagccatgccagttgctggctcagcttactcatacgggggtgctatttacggagaaatcattggttggctattgggttggtcattaattgttgaatatttcttagcagtatcagcaattgcaaccggattttcagcctaccttggtaatttattagctatatttggcattcacatccctaaatatctatctgccggtccaatggagggcggaattgtcaatttatttgcagtattaattattttattcgtcgctgctatactatcacgaggattaaacacctcaaagaaagttgaaaatggcgcagtcgttatcaaaattgccattttaatcttgttcattgttggcggatcattttttattaaaacaagcaattatgtaccattttaccctaaagaatttcacagtggatttggcggtttgaacggaatttgggccgcaaccgccagcattatttttgcttttctaggctttgataccatcgccgcccacgctgctgaagttaagaacccacaaaagacaatggccaagggtattgttggtacggttattatttcagccctattatatacactcttctctatagtgttaacgggaattgtcaattataaaaaacttggtgttgatgacccagcagcatttgctctgcaagttgtccatcaaacacagttctctatcgtcattactattggtgcgttaatcggtatgttcacagctgtattagccttgatctatgcttcatcccgtttaacttattccttcgggcgtgacggtttgctcccccgcagcctaggtaaaatatcaccaggatcgcatttaccagtaaatgcactaattttggcagttgccgttgaggttatttttgcgggccttatccccctcagcacattggctagtttaattaatgcaggtactttaacagcattcgcctttatcaattttggtatcttaatccttcgtcgtcgtaaagatttagctcacgatggtttcaaagtacctggctatccaattgtaccgtttattgcaggtatgataagtttgttctttattacacagctatctgacgagacactcaaaatgtttggcctctggttactacttggtgttatctggtacttctcctatggcattaagcattctaaattatcataacctaacataaaaggagccaccgctcaatagcggtggctccttttatttttactatactaatggtgtttttcgacgcatgtatgaatcaactaatctttcataaacacccggttcagcactgtcaagagctgagccgaggatatccattgcctgcttgaaattataatccctctcgtaaaacatccgtgcttgctcgcttgcagcagcaacacgctcattcgaagcacgataacgattagcatattgtaatagctgttccgtcagtgcagcctgatcaacaatttcttctgtcttttcttttaatgtatcaatgtcagctgatacaatgttcaattgacgttgtacctcatccatatcaatcaaatttgtatttaatgacttagcgagacgctttaattcgtttgatacagcgtaaaaatattctagataagcgactggtaagccaggcaaattcatccgttcaacagcatgcttaatggcttcaacttctttttggtattgcccacccagctgtctagctgatcggtcagctttttctagaccagaaattttatcccaattgtctacctgttgtgtctcaatttcttcaaactgcttcagcaatttttcttgctgaatttgcaactcactgtatgatatttctttggcctcaagcaaatcatcattatgattaatttgctcctctgccatgttgatttgttcaagtaaagtacgtcgtgtttccaactctttatgattaaattggaagctttgacctaatctatccagctcgatcgatagtgtctgattctgctcacgcagacgtaacaaatcagaagatagacgatcggcatttttagtgacgtgcttgcgcgccgttacttccgtttccatcgtttcgtacattgcatcaatgcgctgttcgatatatccagtttgttccgttacttcctttagcttcaaatctgctaataaattcaaaacttgctgacgttgtgagtcaattgcttgaagttcttgctccacgctatcgtttggaaaaacataaccggcttctacaagcttagtgtgcccttgggctagttcatttaattgatcaacatacttaatgtttaattgatcaaacaaatctggaatatcagccatcattttttccatttgagttgtttccatcgctaattgctcataaatatcagaggccgtagcgtggtcaccattctctgttaactctgtaaactcatcgtagtctgcttctaattgactcaaaaacttatctagagcagggttagctggtccaaacttaaagttttcagcaagcaaacgcttacgcaatccttcatacttcttcttaagatcgttgattgcctcgcgatgctcttcatcagttttctttaaatcaagcagaccagcccgcacatctttaatggtggtttccgtatcatccaccataccttgcaaacgttctaattcattacgcgttttaataaagttgatgcctcgagcctcaaaaagtactaaattagcttgttgatcaattttcaaaaacttattattttgaacatcattaaaagaactctcaaatttctgatagttctttaaagactgacctgttaaaggtaactttcgtccctcgacaagctcttcgcgaactttcaaagattcaagctgatcttttcttgctctgaggtcactaacttttttgaccgtagttctttgcatcacaaatattgctaaataagcgatgacaaccaaaagtaatataattgctaagactgtaaagttaaacatatggatagtttccaaccttttaattttcactttccatcttagcacttatacgattcaattaaagaagatttgctaaatctcaaatcgtttacaattttcttaacaatttgctattccttaatggttctgatattatgtaataagttgttaaattgagtagcagtaagtaaagaagcgcgtcaacaacgccccaaatcgttagtaaggccatagctactggctctgagaaacgtcaagataggcgctgcacgcatctggtacttaccctcaaatgtacagcataatacattttggaggacatatacatgtcacgttatacaggtccaaagtggcgtatctcacgtcgcttaggtgtttcattgtctggtactggtaaagaattgtcacgtcgtgcttacgcacctggtgatcacggtgccggccgtcgtgctaaaatttctgaatacggaatgcaattgcgcgaaaagcaaaagttgcgttttacttacggtttgactgaacgtcaattcaaagctttgtttaacaaggctggtaagattcgtaagggtactcatggtactaacttcatgatctcattggaacaacgtttagattcagttgtttatcgtctcggtttggcaacaacacgccaacaagcacgtcaacttgttaatcatggtcatatcttagtagatggtaagcgcgttgatattccttcatacagcgttcaacctggacaagttgtatcagttcgcgaaaagtcaaagaacatcttgcctattcaagctgctatcgaatcagttgtggctcgcccacaattcgtatcattagacactgaaaagcttgaaggttcactcgttcgtttgccagaacgtgaagagctagatgctgacatcaacgaagcgttgatcgtcgaatattacaaccacttgggttaatattttaattcttagttggttgaaacgtcaccatatttgggtgacgttttttaatttttattagtaacgagcaaaaaggcagcctgattttgggctgcctttttgtgcgaacttttttattcgtttaattatttatttctggcattttccaagcatttttataatcatattgatacccttcatttactaaaaaatgatggacatatatttctcgaacagcatgagtcgtgtaaaataagatgttttgttttattagccaattatcaattttcaaataaataagatgtcggtctttttcattttcagtttgtttgaaaagaaaaattaaatactgaagttgttctaataacgacggcgttagcattctttgtacaagcaatgtcggactactaacaaattcaatgtacgcaaattcatcgaggttcatgggaatgtcagccaacatgactaagtctgcatttttttctaaaaattcagtatagtaatctgtagcaaaattatagtaaattatttccatgttcaatccgattttcttagcacgcctttgaatccattttgaaagttcttcagcttcttttgaatgtgataacgtagctagaacgacaggctccccttgatagttcgcttgatttaattttttttgagcctgcgctaatgttttatcccttcgtactgctgaatcacgagaatcataatgactggcaggaattccgccaatgccatcgtaaactcgtgtatcaataacatgatataaagctgatcgaacgaatggttgttgaattattgttgggcgttttaagttggaaataataaactctgcaccaggaaatgtatgcttctttttcacataatcatgattgccgtaatccgccggattaaggagacctgacacaactttccagtcatctactaaataataaactacttcatctatcatcggacgcaacccgtaataatcatcaaaagccgccagtttgaacgtcgtatcagtactttccgtcacctgaaatgcacctgtccccacccaatgaatttcatcaaattcaacatcacaatcaacaataacatattttgcatcaacaacatatctcacgaataagggttcaggtgctgaaaatttgaactggacaatatcatctgctagcaagatgatatccactaaattaacaagttgccagtacgattcccccacttcatttcgaactcgttcaaacgtgcgtttcacatcaaccgctgtcatcgttttcccattatgaaatcgtacccctttgcgcaaataaaacgtccaaacggtggcatcgttatttgactgccaatggtgagccaatccagctttcaatccttcatcgaattgaactaatgtatctcccaactgcaaaactaattgatactcacgtcgaatggccacttgaacaggatctaaagtagtaataggacgtgtcgccagctgtcttaaaacacgcttattttcactatacgtttgtatgcctaaaaaattagtgagatttccccgaaaagatgccagccagctggcaggtactgataattttagcaagtagaaaatcgttattgtgtcctcagtaacaattgcttgcttcatctccataatcacctcatctctgaagctactttgaaaaatgatttgcgttagatgtccacgcccttgtccggggtaataatgcaaaagtttttgctcttcataagcgcgtaaacgacgtttaacctgctttgttgatatcgaccaaaacttagctaattcagaaatactgatagttagtttttgcccaaattgttgatatgtcattcgtaaatcaaagtatgtctggtcaatcattaatttcactcaccttttaaagtggacatttttctatatagatgtccattttaatatctagatgtctattttataatcttaacatatcgtttgaaagtaggataaacaatatgtggaaaaatttacatccaaacatcagaaaaagaatccaaattgaatttttaagtcgcctcggaagttctctcatatttccttttatgtcgatttacctttttcatgcttacaatgcacaaatcaccggtgtgttaatgatgataaatatcatcatttcttttctagctggcatttatggtggatacttaacggatgtatttgggagacgacgtttacttctttttggggagttcattaagttattggcttctattggtattgtctgcgctaatctacccgtttatcattttccttggcttaccttcgtgatgatgtttcttggaaatattgctagtggcttgattagcccagctagcgaggcaatgctcatcgacgtctcaactgaaaaaacacgtgccttcatgtatgccatcaattattgggcgaataacctggcattgatgattgggatgatcattggtggctggttatttgaacggcatttcttattacttactactattctagtcatcataaatattagttcgttacttttgaccaaatatttaattactgaaacccatgaacaaatggttaatataaaaagtcacgttgggtttcagtctgtatttcatagttatcagattgtattatgcaatgttcgttttgttatcttcacattaggtggcatcttattacttagtgttgaatttcaacgcactaactttatcgccattcatttggcacaaagttttatccatacaaaatggttgggtatatcatttgatggtgtaaaaatgttaagtctattgacaagcattaatacagctattattgttttgtttactgcaccaatatctcgttggataactaatcgcaacacgaaaaaaatatttgtaatgggtactacattatttacgttaggctacgctctgcaagcatacgtcaacacgctacccttattaattttttcaagctttatattatcttttggtgaattgatgtatgtcccaacacgtcaatcaaaattagccgatttaatgccagaaaataaacgtggcgcctaccttgcttttaatggttcaatttttcaattaggaaaagtcattgcatcatcaatgctgattggcgccccatttcttggttcgtttggtatagctaccgcgattatttttctgggcttaggagcgattatcttaactctttgggcattacgtttaataccagataaccaaagcaacatgtaggtttagcattgcgccccattgactgagagtttaggtacaaattaacgactaagataacgtataatagaagtatcaaatattaatggagaaaatcatggacgtcaatgaacgcttacaacaagaacagcttggtaatggcagcccaaaaattaaccctgatgagcaaaaccgctatcttggcacgttccgagaacgtgtcattgtcgcaattaaggtatctcaattgggcaattcaaacatccaatcacaatttgccgcatcacttaaatcacatagcattggcaaggttctaattgatcagcaacttgccggcgactatttttcaacgtatgttggtttagcaacgcagagcaaacatagtttcaccttgctttccgactctacaaaatccgcacatcaagaagatccaattgcagtggtactagccgctaatactgctgtcaacgtagataatatttacttaggataaacgtttatgacacaagaaccgctagcgtaccgtatgcgccccacaaaaattgaagagattgttggccaacaacatttagttggtgaaggcaaaatcatctggcgtatggtcgctgctcatcgtctgagttcgatgattttgtacgggccgcctggtactggtaaaacatcaatagctagtgccattgccggttcatcaaaatatgcgtttcgcatgctaaacgctgctaccgatagccaaaaagatttacaaatcgttgtcgaagaagcaaaaatgtcagggactgtcgtcttgttactagacgaaattcatcgcttaaacaaaatcaaacaagactttttactaccacatttggagtccggagcaattatattaatcggtgcgacgacagaaaacccttatattaatgtcacaccagctattcgttctagaacgcaaatatttgaagttaacagtctaagtgaaacagatatcacaagcgctgttaaaagagccattgctgataaagaaaaaggccttgggcaatacaatatcgttctcgatgataacgctatgttacagttatcgcgagcaacaaatggtgatttacgcagtgctttaaatggtttagaattagcggttttatcaacaaaagcagataaaaagggtgtcgttcatatcagtttgccaatcattgaagagactgtgcaacgcaaagcattatccgcagataaagatggggatgcgcattatgatgtgatttcagcactacaaaaatcaattcgcggatccgacaccgatgcggcgttacactacgctgcccgcattatcgaatccggtgatttaccgattttagcacgccgactgaccgttattgcatacgaagatattgggttggcaaatccaccggcagctcagcgggcagtaactgctattcaagccgcgcaaacactaggatttccagaagccagaattccgatcgccaatgctattattgaactttctctctcacctaaatctaattcggcctacaaagcaattgacttggctattagtgatgttcgtcatggcaaatcttacgatatacctgatcatttaaaagatgcacattataagggatcttcggagttgaatcacggtgtagattacacatatccgcacgactatgataatgattgggtagctcaacaatatttaccagataaaatgacaaacactcagtattttcatcctaaaggtaattcgaaaattgaacaacaattatttgatgtctatcagacactaaaattgcgacaagaaaacgggctaaactaaaaagtcaagtctttcagttaacgagttttcgcgttataatactatatgaattcctcagatatacgcattgctacatcatcagctttttccttacaacttttattttcggttgggaattcaggacttagaagatatgccctttcattcggtaatctgacaatcttgatgaaccatccacctcgataatttcgaggaaaatctgcgtagcgattaacggtatcaattgagtgttccgggctaagcctgtgcgtccacatttgtgggcgtttttttgtataaattaaaaccagtgtttaattaggttaaagaacatactattaattttattatgaaagcgctatactagagatatagaagaacgcattgcatattgcaagaagggatgttattatgacagcaaattatcataggattttagtaccaatggatggatcaaaagaatctgaagctgcattaacgcgcgcgattgaactgaccttggatgctggtgatgaaggcatcttgtcaattttaaacgttatcgatacccgtgcatttcaaaatgtggctagttttgacgatacaatggttgaagcagtttcagatgaaacgcgtaaaagcttagaaaaatacaaagcacaggcaattgaagctggtgttaaaaatgtcgattatctaatcgaatatggttcacccaagtcgttaatcgctaaagatgtacctaacgaagtcaatgctgatttgattgttattggtgcaactggattaaatgctgtagaacgtttagttattggttctgttactgaattcgtaacgagatctgctaaagttgacgtcctagtagttcgcggttaagttattgctcatataaaaaagacactacaatgatgtagtgtcttttttatatgtctttatttatattgttttagatcaacatcttttagagcaattagcttcgttttgtgagaaaccttgtaccaaaagtataagattacaaacaaaggaactgataagtaggtcacaaatattttttcccaatttagatgggcaaaactgtccggatcctgaccaataataacaccaatagaaatcactagcgcaaatagtggaccgaatgggaaccacttagccttgtatttcaaatcagacagactctttccttgcgccacataagctcttcggaagcgataatgagagatagcaatgccgacccaagcgatgaatccagttaacccagaagcattgaccagccaagtataagcaactgatccccctttggtgttagcaataaatgctaataacccaatcgcagtagttaatactaaggctgcaactggaacccctctagttgaaagcttggcaaaaattttaggggcatcccctttacgcgccatagcgtacaacatacgtgtagaagcatatgaacctgaatttgctgacgaaacaattgacgttaagataactgcattcattaaactagccgcaaaagcaattcctgcgtttttaaatacgattgtaaatggtgagaccgcaatgttttgtgtggaagaactcaacaagcgcggatctttatagtaaaccagagcggaaatgacaaaaattgccagaatataaaacaataagatgcgccaaaacacttgatttatcgccttgggaactgacttatcaggatcctctgcttctccagcagtaataccaattaactcagttccttgaaaagaaaatccagcaacaacgaatactgacaagatagcttgaggtccaccaacaaatccgtgattaccgaccgacaagttcttcatgacattgatgtcagaatgaattacaccaaaaatagtagccagaccaacaatcaagaaggcaataatagttactaccttaatcatcgacaaccagaactcagcttctccaaaagttccaactgaaaaaatattaattaagaagataagtaataaagcaatcgcggaaaatatccaccctggtgtatttggaaaccaaaattcagccaccaagccaactgccacaatgtcgacagctaatgttatagcccaattaaaccagtagttccatcccatggcaaatcccaatgctgggtcaacatatttaccagcatagtcggaaaatgaacctgaagttggtgaataagtagccatttcacccagcgaagtcattaagaaataaaccatcacaccaatagctaaataagcgacaatagcacccagaggacctgcttgcgcaacagtggctcccgaagctacgaataagcccgttccaattgaaccacctaatgcaatcattgacacatggcgcgtttttaaattacgctgtatgtgccctttatgttcagacataaaatctccttctcaaaataaaaaaacctctccttagcaaacaggaagaggtttaaaaagtcattatataatcacttttcaaagcgcaccgcatttctgcgacagtctagcaactcttaatcactagcccaaaggttatcttgcctgttaaccctttcggcaaccttcccttttacatgatttcaacatcctggcggactcattcatgtgactcatgttggctgcaacctctttgacaatatgaaaataataacacacttacacgcgcccgtcaatttcaagtaccttttgccaatgtcgcgcccgtttataatattgttgtgcactaaactgccaccaaaaataaccaaaggtaattgctcccaagccactagtcaatgccatatgatgagattgaatacgggctaacataattgataaccaaaataaaccaattaaaatattgatcatcacttgaatttttctcgacttaaccaaatgtggcataataatgactagcagtaagagcaattgcaaccaccacaccaacaataagttaggaatagtttcacctattttaggaccatcctgccaatggatgcgcaaaataattgtaataacccatgtcagcaacatcgcaacaagttgtgtaatggcaaaccaccaggcagcaattttgtaatttattaaataaagaaatgctaccataaccgctatcaatgggatgacgacccaataatgggaaaaaagattacctaaccctaagtataggggtattttcaacgataaaatattgtttactgcaaaatctgtagtcgcgtccagaacttgcataaatatcatatgaaatctaacttgaatacctaaaaaaacaaaaataatgccaaaggtaatgattaaaatttttcttaatttatccggtggaattaacattgtttataattgtgatgatacggataagcatattcaatatgctcaattgaccccgcttgctcacattctcccaaatattaaatttctacaaactcatttgcttatagctcttaataattgtagcattatatgagatataattataaaaaaaagctgatatggttaaaatttaatcttgactttaacttggtccgatatcattactatcagttggtttcttgccgatatttttagtcgtgcccttaaatatctatacatggcagatgaattattgctagatgaataatctcaaaatatggtgagaacactggttactattttttgattgatcgttagtttcaagccttttgcctttgttgcccaaaaatggtagtatatcgataaaactcggtagctgtctttattatcttacaaaccgccatatttcattggccaaaacaatcgagagaccgttatgaaaaaaaataaacaaactgcagttaagtccagaattgatcgctattcaaaaagtagtcacagactacgaaatattatcttgcttattgtcggtctcttacttatcgtgtcaggcacatttgcttggatggctatccataatactaaatcagcaattgataaaacatacaagagcagtggcgtcactaaatcccgaaacgtctcaagcgttgttcaaagtggaaagcccttgtctattttgttatttggaacggataccggtgaattaggacgtacatacaaaggacgtaccgattcaatgatgttgcttcttgttaaccccaagacaaaaaaaacaacaatgatttctatccctcgtgatgcaatggtttctattccggggtacgaaagtactttccctcaaaaaataaatgcagcctacgcctatggttcaacggcaactgccattaaaactgtagaatcttacttaaacattcctattgatttttatgccttagttaatatgtccggcttggaaaaaatggttactcaagttgggggaatttctgttaagtcccccattgacttcacttatagtcaggaaacagcccatgcttacggtgcaaacctataccgtttccacaagggaagcacaggctatgaacattctgatgataatggggtcacttggtcggcaaccaaacacgtcatgactggtgatgcagcccttgcattctcgcgcatgcgttacgatgatccagatggtgactatgggcgtcaaaaacgtcaacgattggtattagagggtttgatcaaaaagtcagctaatgtttcaagtttgttaaatacaaagtttatgaatacaatgagttcaaatgttcaaactgatttgtcatttggagatataacgacaattgctagcaaatacattaatgcagcgaaaaatattgtcaccgagcatattcagggtgtcagcacgagttatcctgattctgaagggaacaacgtttcatatgaagttgtcactcaaaaagaaaagcaacgcgttactaacttagctcgtaaagcacttggcttaaagcacgcttccaccggttcagcatatggtggtgacataccaagttctctacaaacaatagctgattctcttcgaccagcagatgatgaatcaacagattctgatgattcttcaaattaaataaaaagacgcctttaaaggcgtcttttttacgttttttatttatctatgaaatgaccgtcgcattgcgaacaactaaaggactaaaacatctcatttgaaaattaagggattgaagaggagcacatatgatactattgctatgtcagttcttcgctcaatcatatatatttctgtccgatttaatcaaactaatagcattctattagatcaatatttacaaatactttactccttattcgtgcggcgagataagaatatataaacagggtaaccaacagcgacaattgctatagaaattattacaccagacaaatcgtgcataatctcagagatttcaacatagagtgaaccacaaatagcgacgattggtatccaaggatacagcggcatagaaaagctacgcttctctccaaaaggatcctttttgcgtaatttaaaaacaccagcaaaaacaagtatataaaataaaaaggttgtaaaaatcgcaatatcggttaatctatctggatttgtaaagacaatcattaaaatgccaagaaaaatcataaaccaaatggacttattaggtgttcgagaacgcatattgattttggcaaattgtttggcaaacggaaacaatccatcgttagccattgcaaacaacacccgagggaatgaaacgattttcccgtttagtgttccaagtaaagaaattaatacagcgatactcaataacctgccaccaataataccaaatgcatttgtagccatgtataacgttgtgttttgtcccaacttaacaatagtattagcgggcaaactctgataaacgccaaaactcacaccaacataggcaactagaacaatcaaaataccaaaaataatagccttgggtaatactttttgtggatttttaatttcaccacttatattagctagagtaacccaaccatcgtaagcaaataaggtggctaatacagccactccgaagccaccttggtcactctgcgaaacctgagcaacagtctgtccaatcgcatcatgctgtccaaaaaaaaggccaaaaatgattaatgcaataatcggcaacattttcactgtagttgttattatttgaaaaccggcactgaatcggtttggaattgagttaataagacctacaaaagataatgcaataattgcggatggtatagctaaagacttagataatccaaataaatcaacaaataaaatgccaaaatatgctgcaatagatcccatcattgctgggccgtaaaataccacttgcatccacccagctaagaaaccccaaaccttaccataaattttctcgatataaatataaatgccaccagttttgtccatttgagagccaatttcagctacgctgattcctgacgctagcgttaaaagacctccagcaatccacgctagcatcgctgcgtttgtactacctgctgattctaagacactgccttgcttaaaaaatataccagaaccaatgattgttccaacaactaaagctaatgatgctgttaatccaaaaccacgattcaatttctgttcattatttcccatcatatctccaagataaatagatgatatctttattattcatcaatacccatcacatcaaataaaaaagttcggaaagtccgagcttttaattactaaaataatccagtcccatcacgtgacggacatctttcattgtttcctcggcgacaacattggctttatttgagccttcttgcaacatgttcaaaaccgctgggatatcttgggcgtattcttcgcgtcgttgacgaattggtgccatttcagcttccatgacatctatcaaatgcttttttattttcatatcacctaagccaccagcagtatactgatcttttagttcttgaacacgttttttatccggatcaaaaatatctaagtaagtaaacaccacattaccttcaacatgaccaggatcagtaatattgatatgtaagggatctgtatacattgacttaacttttttcaccaatgtatccgcatcatcactcaagaaaatgccgttatttaatgacttggacatttttgcattaccatctaaacctggtaaacgcccttgccccttgggtggaaaaacaccaactggttcaactaggacatcagacttataagcattattgaacgagcgtactaattcacgtgtctgctcaagcataggttcttgatcatcccctactggcacctttgttgctcggaaaatagcgatatcagctgcttgtgatactggatatgtcaaaaatcctgcagggattccctcatcaaagcctttttgtttaatttctgacttaactgttggatttctttgcaaccgagcgacactaaccaagttcataaagtattctgtaagttcgaataaccctttgatttgtgattgtacaaaaatggttgtcttagctgggtcaataccaaccgccaaatagtccaaggctacctcagttaatgattgacgtattttttctggattacgagcattatctgtaaatgcttgtgtatcagcaatcataacaaatggcaagtaatcgccagaattttgcatgctcacacggttttttaacgatccaatataatgaccaatatgtagtttaccagtgggacgatcaccagttaagtaaatttcttttgacatgttcaaaaccttctattaattagttaactcattctattatacgttaaatctaggagcagcgttgaagaaattatcacaaaacaaagtacgttattattgacattttcctataaaacttatacactatcactattaagaagaaagaggtacgagaacttgttgaacaatttttaagatgtggtgaataaaagcaatagattgtttttatacgcttttcttgagattggtctgcctttttcgtactaaacacgtaaactgccaccagtctcgcaagttgattggaggcattttttatgcaagaaaaccctcgcaaagtatttttagttggcttaacaactaatcagggaaacctagactacgaattagaagaactagcgaacctagcaaaagcaaataatcttgaacccgttgaaacttttacccaaaagctagaacgaccaaatcctagcacttactttggtaaaggtaaggtcgaagagttaggtgaagctgtaaaaacttatgacgttgatatgattgttgtcaacgatgaattgacaccttctcaaattcgtaacctagaaaaaacaacagatgctactgttgtcgatcgtactggtttaattctcgaaattttcgcacaacgagcccagactaaagttgcaaaactccaagttcagttagcacgtttacaatatcaattaccacgcttacgtacaagcatgtcaatttcattagatcaacaaacaggtacaggtggcgcaggtttcacctcacgtggttctggtgaaacaaagctagaacaatctcgccaacgtattacgtctcaaatggttcatgttcgtcaagaactggctgatttagataaaagtgaaaatacgcgttcaatgcaacgacacgctaacaacttaccaaacgtagcactggttggctacacaaacgctggaaagtctaccttgatgaatcgtttgttgatgcgttttggtgttggtgcagacaatgatgatagtaagcaagtgtttgaaaaagatatgctatttgctacgctaaacaccacagttagacaactgactcttcctgataaaagacagtttttattaagtgatacggttggtttcgtatccaagctacctcataacttagttgctgctttcaaatcaacattacaagaagcggcaaatgcagatctaatactgcacgtggtggatgtttcagacgagcattataaagctatgatggaaacaactgagaaaacattaactgagattggtgttactggtaaacccgttattacagtatataacaaagctgatcgcactgatttgcactatccggacatctctggcgataacgtgattactttgtcagcactagataccaattctcaagatgcattgattgatctcattgttaaacatatttttaacgacagcgaagtcgtaactttgcatataccctttgataaaggaaatgttgttgcccaattagcggcaaaacataaatttatagaagaacaatatgacgaaaccggtagttggttaaccattgagctatctgaagttgagcgaaacttatttcaacaatatattacgaaagaaaaaagcatgaattcataagaattcatgctttttcttgaaagtaattatgccgaccgccgggctcaaaccggcgaccccctcattactagtgaggtgctctatcaactgagctaggtcggcaaattaaagtactcaggtactacaagtgaataataccagatacctcaatatataaatatggcggcggccatattatacgggtgacaggaatcgaacctgcacggattactccactggaacctaaatccagcgcgtctgccagttccgccacacccgcatgtatcacacaaccctttaattctactggaaaaacctaaatcagtcaagagggtaatacaacttaaatcaaaaaaatgttaaaaaactgctattctaacgattccttagtcaattgacgcatttcaatggcaaatttaacaacagttcgagcaactgcatacattggcacaatcaatatcatgccaaaaataccccaaagattaccggctaccatcaaaagaatcataattgttaatgggtgaatttgtaatgattttccaataacatttggataaataaagtttccatccaattgctgaacaaccatcatcacaatcattaccaacaacatttgtttccatgattgtgtactggcaacaatcaacgctggtataaccccaatccaagggccaatatatggcacaatgttagtaataccagcaatcacacccagtaaccatgcgtatggttcaccaataattaaataacccacagccatggtcaccccgacaaacaacatttcaagagcttgccccgatatatatctttcaatagttttatccattttaagtgtcaattctttgacattatcagcaaaacgaaccggaaaaagcttctggattgctggtagcaagcgatcaccatcacttagcatataaaataaaacgactggaatagtcacgacattaatcgtgaccgatgtaaccatcgagacagcactgcctaatgtacctgccgtaatagttaaaaaagaagccgagtacttgccaacagcactctttacttcatctatatcaattgacaaatttaaatttgataaccacttactttgtagtgaatctgttacaaagcgctgtacgttttgtgcaaattcaggtaatgcagtaattaaattagtaatttccgccactagagttggtatcaataaaatcaaggaaccagctatcacggctaggaacaacacaaaagtaattataacagccagttgatgcggcattttatgccctttaactgtaattttctttaaaagtgtcaaaacaggtttcaaaacatagtacaaaaatccggcgacaatcaatggtacaaaaaccgtggaaataaatactgaaattggtttcattagaaaatcaaatcgggaaacaatcaaaattaagagcgatagcgctaataattcaatggtccaaaaaaatatatttttgtatttagaattcggtatcatataatttctccaataatttatgttgtacctttggtaagcttaatgccgaccactcatcagaactaaaatattgttgattatcattcaacatagctgtttcttgcttcactaaccaaatttcccatcgacgatgtgtaaaaatatgtgtcacgggcttaatatttaactgttgacccgtaattgattctatactttcaatttgcgttagtggaaatgtccaaaatccagccaacaaaccgctatccggtcgtttttcaaataataatttaccatctttttcaaaaactgaagccataaacaactgttttactggtcgttgtttcttggttttaacagggtattgatcctcaacaccatctcgaaaagccgcattaaattcacgcaccggtgaatacaagctatcgggatttttggttgtcatataacttgatcccaaatccataattgcttggttaaagtcccctggtctttccggatcaacaattggcgcaataatatcataaaatatcttacgtgattttgtatcagcaatgtcagcgtcaattttaagtaatctactaaaaacacgatattggttgccatcaactgctgggactacctcattgaaacttattgacgcaatagctgccgctgtatatggacccactcctggcaagctttgcagatcatcactactctctggccattgcccatgcaattcattgacaacaaactgcgccgccttttgtaagtttcgcgctctcgagtagtagcctaaaccctcccataatttgagcacaacatcctctggtgcggtcgctaaatcaccaaccgttggtaacgatgtcataaagcgatcaaaatacggaataactgtatctacgcgtgtctgttgcagcataatttccgaaactaaaacgcgataaggatcatgattgacacgccatggcaagtgcactcgcccttctttatcataccaattgagcaatgttttacgaaattctttaattgtttgttcattccaagtttccataatatatattgtaacacttgtaatcgtatagattttgccgtataattattatttgtatgaaatcattgaataaaaaaggagcacaatcatggtattaaagaagccacttaactcatttgcacgtgcccgcaaagttagtcatagcgctgctaagaaacaacgtcaagctgctatcgcaaaattgcaacaatgggcaaaaggtaagtcagaagaattaccttctacaaagtaattttattgactacttaaaaccagtatttatactggttttttgtttgcatttttatgaataaaaaccatgaaaggtaggatactgttgaatataacacaaaagcaaaaaacaatcttaatcatattagttatcggcacctttttaggctttttgaatcaaacattaatgaatgttgccttgccagatatcatgcgtgaatttcatatttccacagacttgggtcaatggatgacaaatggctacatgttagtcaatggtgtgatggttccgttaacagcttttctgattcaacgcctaacaacacgtacactatacttgaccgccgctggactattcgccgtcggaacagcaactgctggatttgcgccaacatttgatgtcctcattatcgggcgtatgattcaagcaatgggcgccggtgtattcggccctttaatgaacgtcgttgtcatgaacttgttttcgcccaatgaacgcggatctgcaatggggacaatcggtttggcgcttaatttcgcccctgctttgggtcccagcttgtcgggattagtcgttactaatttaagttggcgcttcctattttatcttgtcgcaccattaattattgcgaacttcatcttggcttatttcttactacaaaatattgggcaacaaaagaggttaaaattcgattttatcggtgttgttttgtcaagtattggtcttggatcattactttacggattttctaacgcaggtgcaaccccttggaatgagtttactgtatggggatttgtattaataggtattattgttacaagtttattcatttggcaccagtatacaactaaaacaccattgttaaatatgtccgtatttaaatatagacaatttaacgttgctgttttaatcaacgttgttttgatgattgctatgtacggtggtgcactgatgttacccctctatatgcaaaatgtgcgtggtaccacggcttttcaatcaggtctagtgttgtttcctggtgccttagtaaccgcatttttatcaccgtggagtggtcgtttatatgatcgctacggtgctaaatacttaacattagttggtattatgattacagcgtttggcacttttattttagcttctctgacattaacaacttcactttggctcgctgttctcggacagtttgtccgtcaacttggactagtcttggtcctgatgccaattcaaacagaggccttcaatgcgttacctttaacactcattcctgatggatctgccatgtttactacaatcagacaacttgcagcatcatttggtacagccgctttggtaacaattatgacgaaaagtgcacttaactatggtcataaacacgcacacctcagtgctgaaatagttgatttgcatggtgtacaagtaacttttttaactgctgcattcttaatgttggttgcagcaagtttaactagcctactaaaacttaaaacacgcgccacataaaataaacagctattgtttgctataatgtaactataaaacacaaaggagtctcgactatgaattatggtttcattggtgctggcaacatggctactgcgatgattaaaggcttgatttacgcaggtattgatagcaaaaatatttatgtttcctctccacacagtgcggctaaattggcagcaaatttacatatccaagcagccgactcagaaacaatcacaaaaaagtgtgatattgtcattatcgctttcttgcctaaccaactacgtacgctgggtaattctttaaacctagacggtaaaattgttatttcagtacttgcgcaagtgacgattgcggatcttgatgaagtgttcccaacagcttttaatgttcgttcattacccaatattaactcagcaatcggtaaaggtagtaccgctttagcattttcaaagcgtttaagcgagagtcaaattgaagtagtgcaaaattactggcatttgttaggtactactagtgtccttgatgaacaacatttcgctattttttcagcaatcgcgggttcaggtcctgcatttgtcctcaaatttatcgatgcattaactcaggctggcatcaacaacggattagatggcgagagtgcagccgccattgctgcttcaactgtggctggtacaactgaaaccctacaaaaatcaaatagcgatgcagtaacattaatgaacaacgttgcttctccaggcgggtccactcgtgctggattggataattttgaacagaatgattttgatactattgtgaactcagccatcaatgctaccgttaatcataaacatacttaagtgttcttagaacgctttttatttgcattttttatacacaaaaaaagccacaacctaagttgtgacttttgatagctcgtgagagaatcgaactctcgattctgccgtgaaagggcggcgtcttaaccacttgaccaacgagccatgatcaatatgtcatttgtttcaatcaaacaactatattagtatatcaagaatactaattatcgtcaacccttttcttcaaagtcattaattttgtcggatcaatctgttgtctgggctgagttggcatacttttatagtatttccaaggtgtctttggatcgaattctatgtcagttgttactgggaacccatttttaaaacgagttaataaccacttttttagtggcttgggtactcccaatagatcaaaatcggctggagaaacagcgtacctaatagacttttcatcatttaattttactttctgaacccaatttgggtcagcaatcagcgctctacccatggctgcaaaggtcactccttcatcgagtaatgactcaacttgcatcggttgcttaatgagtcctgctaccattagtggcacattatctggtaaaacttccgtataataagtcgttatttgtttgacggcttttgcgtcacgaaaaggcttttgaaaagcatcctttagtgatagatgtaaataatctatctgtagagtaaccaacctttgtacaaaagctaatgagtctgccaatgtaatccctggggtagttgattcctctggagactgcctatagcccagtaaaaatggacgctctgcatacttatcgatggtatcaccgaccttagcggcaaccgctaacccaaaacgcattcttttttctaaagtcccaccccaaatgtcttgacgtcggttactttctggtgaaaaaaactgttgtaataaatacaaattggcaccatgcaactcaacaccatcgaatccagctaatatggcccgttttgttgctgctgcaaaatcctcaattgtttgcgaaatttcctcatgtttaagctcacgaggcgtttcatggctaccgtgagggtaaggctgagcagaagctgaaacaatttgttcaccacgcaaaattgtttggtttgattgacgaccagatgcaaataactgcaaaatagccttagcaccaccagaatgaattgcactagctaaccttgacagtccctcaatcttatcgtcatcagcagctgaaaggccaccttcccagccttttccgagttcattaacatatgctgcctcaacaataatcattcccggaccatttgagcgcatttgataatatttcagttcattatctgacacactgccatcttccagagagctttttagcgtagttggcgccataactacatggtttcgaactgttattggtttatttttaaatgtatatgagtctaaaaaatcgtaatttatttgcataaatttattataacgaaaaaaaacgccaaatggcgattttcttttttataaaactaaattttaataccaaccagtagaatttgaatgtgccaaagcgttaacagcagtaccataacgggctgcaatatatgccttcatagcattcaattgatcattgtagtcggcagtgttaccaccgtaaatagaacgtgcttgtgcagataattgacccaagccatagtattgaccgttagtagcattaacatttccacttgattcacgtgcaatcagtgcattcaaagcagctgtttctgatgatgaagatgatgacgttgttgttgagctagtagcagctgttgttgttgaagctgtttgtgttgaagttgaagctgtgttatcagttgaagatgttgttgaggctgcttgtgttgttgatgaagtatcagcagcagctgttgttgttgaagctgtttgtgttgaagttgtgtcatctgtggcaaaactcaaatgttgtcctgtaacgatccagttaacatttgaaatgttgttttgagcagcaattttgtcaactgaaacgttgtactttgctgaaattttatttaatgtgtcacctgattgaacaacataatctgttgtatcggcacttgcatgggctcctccgaacgctaaggcaccggcaacaccggcagcgattgtcaaagtcttcttaatattaaacatatatatttgtactcctaaagttgtctgttctgatttagatacaccagaattggcacatccatgtaattaacttacgagtattagtttagtcgttgaatataatagacaaacgtctggaacatatcaagaatattacatactattatttactatacactctactatcaccttgtcttataacaatcttaatatttggttatctgcttaatatagatgttttctgtcttttttaattgcactaaaatgtagtttttagcctaaaaatgtcattatatcttactttgaactaggacttattatcgatattcaatcatttttcattataaaaaccctcgaaacaattatttcgagggtttaaattctttttatttagcggcccgatttcagagcagcaacgtgaatacggttcaccgcacgcattaaggcaattcgtgcgcgacgtaattcagcgtcattatgatcatcttgtgcatgtgccaaacgtgcttccgcacgctccttggcgctttcagcacgtgacacatcaatcacatccgaagtttcagcactatcggctacaactgtcaaagtatcatttgaaaactcagcaataccaccattaacagccaatgattccttatcatcaccgcgcttgacgattaactcatcaattgttagagctgctaatatcggtacgtgctttgccatgatacccacttggccaccttgagtgtttacaacagcgatatcaataccactttcattgtaaacttcacccgctggtgtcacgatttgaacagtaatgccttttgttgcagttgttgtttcatctgccatatgtcaatacccccttattgggccattgtcttggctttttcaacaacctgctcaatagcaccaacgttacggaatgcatcttctggcaaatcatcatatttaccatccaaaatttccttgaatgaacgtacagtttcagcaactggtacatattcaccattgataccagtaaacgtttcggcaactgaaaatggttgtgacaagaagaattgaatacgacgtgcacggttaacagtcgtcttctcttcatctgataattcatccatacccagaattgaaatgatatcttgcaattcacgataacgttgcagtgtacgttgtacttcagtagcaacttcataatgttcttgaccaacaatttgtggatccaaagcagaagaagttgatgccaaaggatcaacggctgggtagataccttgttgtgtcaatgcacgttccaagttagttgttgcatccaaatgcgcgaatgttgtagcaggcgctggatcagtataatcatcggcaggcacataaacggcttgaattgaagtaactgaacccttcttagttgaagtaattcgttcctgcaattggcccatttctgttgccaatgttggctgataaccaacggctgatggaatacgtcccaacaaagctgacacttcagaaccagcctgagtgaaacggaaaatgttatcgataaacaacaacacatccttaccttcattatcacggaagttttcagccattgtcaaacctgttaaggcaacacgcatacgtgcacctggtggttcgttcatttgaccataaaccatggcagtttgtttcaaaacgcctgattcttccatttcatggtacatgtcattaccttcacgggtacgttccccgacaccagtaaagaccgaaataccgttgtggccttgcgcaatgttgtgaattaattcttgaatcagaactgtcttaccaacaccggcaccaccaaacaaaccaatttttccaccacgaacatatggagcaagcaaatcaataactttaatacctgtttccaatatctctgtcgagcttgtcaactcatcatactttggtgcatcacgatgaattgagctacgacgaacatcagaagcaattgcaccattattatctacaggttcacccaatacgttgaagacacgaccaagtgtagcttcaccaactggaacctcaataggattaccagtgtcaactactcccatgcctcgttggagcccgtctgttgagtccatggcaatcgtgcggacaacgccgtcacccaaagccaaagatacttcaactgtcaatgattgcccattacccttatcaattacaagggcattgttgatatcaggaacttgttgccctgcttcaaacgcaatatcgacgaccggaccaatcacttgtacgacttttccagtactcattgtcgtttcctttcagtttttaagtataaggctatacatgaactgaaccgaccaatgccaaagtagccattggttttgattcctttatcatgttataccaaatacattcctacacaaataaatgtgcgtatttttaatatagattgaatggcattaattagcttattccaaagccgccataccaccagtaatttcagtaatttcagtcgtaattgctgcttgacgtgcacggttgaactgtaattctaaacgaccaataagatctttcgcattatcagttgcacccttcatcgctgtagatgaagcagcgtgttcagccgtttttgcatcaagcactgcttcatacactaaactttgcgcaaactgtggcaaaacaacgttcaatactgctgttgtatccggttcgatttcataagttgcttgaacattaagttcagctttttgttcttccgttccacccattgcattcagagtgtccccagttagtggcaataattgcacgtccctgtattcactagtcaaacggttcacgaaatggttataaaccacatgaagtgcgtcaaacacttcattttcatatagacttgtcaccgttttaacaaccgaacgaatttcattaaatgttggaacatctgacacaccgcggtgttctaaaataacctcaaacccacgtttcttataaaaatcagctccattaccaccgacagccaaaatcgttgtattgcttgtatccaaattcagattttgcattaaaacattggtttgtttaataacatttgcattgtatgatccaactaacccacgatctgatgtgaccaccagaataccagtttttttaattggacgttgtgcaatcaatggaatatgatcagcatctgcattatcaaagaggtgagctgaaactaaatgttcaacaactgcctctaaacgagctgcataagatccataccctgcactgtatttttgaatttgacttaattttgccgttgagaccatttgcatggcactcgtaatttgacgtgtttttttagtggatgaaatacgacgctgaatatcttgcaaagaagccataacagcgcctccttttattctgctgattcagatccagcaaatccagccttaaaggcttcgattgctgcattcaaatcagcctcttcaggtaagttctttgtttcaacaattgttttgaataattctgaagcatttgcatcaacatatgcaatcaattcatcttggaaacgttgaatatctgctacttcaacatcatccaagtaaccatgtgtcaatgcatataatacaacaacttgatgttgtacgggcattggtttgttcaatggctgcttcaaaatttcaacagtacgacgtccacgagcaagctttgcttgggttgctgaatccaagtcagaaccaaactgcgcgaaactttctaattcacggaaagaagccagatccaaacgtaatgtaccagcaaccttcttcatagccttaatctgcgcatcaccaccaacacgtgaaacagaagttccagcgtcaatggcaggacggacaccagcatagaattgatcagcatctaagaacacttgaccatcagtaatagaaattacgtttgttggaatatacgcagaaacatcaccggcctgcgtttcgataaatggcaaagcagtcattgaaccgccacctaattcatcgctcaacttagccgcacgctctagtaaacgtgagtgcaagtagaaaacgtcaccaggataagcttcacgtcctggtggacgacgaagaatcaatgacagctcacggtaagccgtggcttgctttgataaatcatcatacacgatcaaaacgtgcttgccattatacatgaattcttcacccatggctgcaccaacataaggcgccaaatacaacattggtgctggttcggaaggaccagcattaacaacaattgtatagtccatagcgcccatttgacgtaaggtttcaacttgtgcacgcacagttgaattcttttggccaatggcaacatagataacgatcatgttttgatctttttgattcaaaattgtatcgatggccaaagaagttttacctgtcttacggtcaccaatgattaactcacgttgtccacgtccaattggaacaagggcatcgattgctttaatacctgtctgtaatggttcggaaacggatttacgttccataacaccaggtgcttttacttctacagggcgtgtcttatctgtcttgatttcacccaatccatcaattggttgacccaaggcgttaacaacgcgtccgattaattgttcgccaactggcacttccatgatgcggccagtacgctttactgtgtcaccttcgcgaatatcgtcaaaaccaccaagaatgataattccaacttcgctcgattcgaggttttgggccatgccgtaagtgccattagcaaattcgacaagttcaccagctaaggcatttgccaagccagttgcacgggccacaccatcaccaacataagtgacagttcccacttcttctacagttagcgttgtgtcgaacttttcgagctgttgcttaattaaagcagaaatttcttcagcttgaatagccattattcttcctcactaacctaataattgtgccttcattttggcaatttttgtttgcaagctaccatcaattaaagttgattgtgactgcaagataacaccaccaaggatgctttcatcaactacgttttcaatattaacttgctttgcacctgtttttgatgcaaagacagaagctaatttatctaaacgtccatcgtctagtgcaacagccgtagttgcttgcacatccacgatgccatttacttcattatattggctgacaaattcatcaactacaattgataaaatgttcaaacgattgttaacctgtaacagcttaaccaaatttttaactgagtcagtgctgttacctgttaatgtttttaacagatcatcacgtgaagcaatagcaacgtccgctgatgaagcaatagttatgaaattttggttttcatcaagcactgttttaattgtgcgtaaatccgtcaaaacctcatcaacattatcttgttcgccagcaagttcaaaaattgctttggcgtattggttagcaatatctttaatattctttgccatcccaatactccttatttagtttctaaatctgaaatgtaagcatcaattaatgcttgttgatcatttaacgatagttctttttgcattaactttgaagcgattgccaccgaaagggctgcaacatcgttttttgcaccagaaattgcgtcttccttgagcttttgcgcatctgtctgcgcttgttggctgacagaagctgcgcgatcgttagctgcagagacgattaggtcactttgcttttgagcgctagcttttgcatcattaaccacttttgtggcattttgacgtgtttcagccaattcagcttgacgttgtgatgctaattcctctgcctcttgacgagctacttcagcaccatcaatgtcagaagaaattttatcagcacgttcatcaagaacttttgtcaatggtccgtaggccaccttcttcaaaatgagcatcaacaagaggaaggcgatgataataaacagcatatttccaagtggaagtgctgccaatgttgttattcccaacatgattttcctccgctactattgtgtgattacttgcccatcaacatgaaggcgaagacaattgacaaaattggcataacttcgaccaacgcaacacccaagaacatacgtgacaacaaacgaccttcaagttctggttgacggctcatgcctgccaagaactgtgaaatcaaaacaccgttaccaataccaccaccaacggcggctccagcagctgcaagacctgctgcgattacaccaagattgtgcaaatccattagatttctccttattcgtagcgcacacacaagaactatttcaagcgtgcgcatttatactattttagatgatacgctctcgcgttttataagcaaaccaactcgtgttatagaatcattatttacacagtgcctctgtaacacaaatctcatttgctttgcaataacactcttactcgttacccgacaactgtgagatgaatacacctgtcaaaatgacaaacacatatgcctgaataccaccgatgaagagtgaaaagccttgccagaccatttcaatcggcaatgccagcactgaccagagcccattaaagtgcccaggccaggccaaactgttagccacgagcgttagtaacatttcaccagcgaagatgttaccaaacaaacgcagtgacaacgtcaagaaattggctaattgttcaataatattcaacggaagcatccatgaatatggggtgaagaacatgttcttaatatagcccttaaaaccaagttcttgaacgcccataccgtgagcaaccatcaacgacataattgcaagcgtcattgttacaatcggatcagcagttggtgacttaatataagtcacaccatcgccaagcttaaactgtattagcaagcccatttcgtttgacacaattacaaagaaaaacaatgtaaatgcgaacaaaccaaactggcgcgcttgcttctttgttagctgtccattcacgataccgttggtgaaatctaacaaatattcgattgcgttttgccgtttgttaggctttacactaagtttgcgggttaacacaattgagacaatgataacaattgccatagccagcaacgttgaaataatcgttgtccaatcaaaggttagaccaagaaacttaaacgttgccgttgggtcatccatgcgccttctcctttctcatataatttggcgaaatggtcgaaatcggctattcgtcataacataaaatatatgatacgcctttcattttgaaattcaactgtttaccgcgatgtttttcacaaactttttgttttccttaagagaaacgttgttagttaagttcttccgacctaaatataagaataataacgtttatcaggatttttacattattttaaatgtatacgtttacaatttctgttcgtatcacaaactttaacatttttatagaatagtaaatttcagaccaatgtttattgactgtctaatcattaataaaaaagagccgaatttttaacaaattccgctctctatgatttacttttcacttgcagccacttttggcaacaccaaattcaatacaatgcccaaaatagtagcaatggcaactccagaaaaatcaacttgtgtgcttaattgtaaatgaaagtttccaataccgacaaccataataggtgctgcaatcattaaattacgtttcttactataatcaaccttattgtcaacgataacttgcaaccctgcagccgcaatgacaccgtacaacataaagccaacaccacccgtaacagcgccagggatcgtcgaaatcaaagctgatagcttaccaacaaaactaaaaacgaccgcaaaaaaggctgctccaccaatgacccaaactgaataaacacggctcaattgcataacgccaatgttttcaccgtaagatgttaccgctggtccaccaatcaatccagcaacaacagaagccgtaccatcccccgttaaggtacgtttcaaacctggattttcaaaaaaatcagtcccagtgatttttgacaaaaccatcaaatgtcctagatgctcagacagcgtaactaaagctaatggtgccatgctcagtacagcagctggataaaagacgaaaccatctttaccaatgaacgtctcaaaattaggtaattggaaccaatgggcagaagccacagggcttaaatctactagaccagtgattaaagccacaatataaccaaagataattccaagtagcactggcaatagtcctaaaaatccccttaaaaacatattaaaagcaatcgttgccagcaacgtaaccaacgcgaccgtaaacacacgaatatcataatgtccattcatggtagtcgctgaggaagcagcagaaccagctagactcaagccaattaccatgatgataggtcccacgacctcagctgggaaaatatactcaatccaagcagtgccagtaaaagttacaatgaaagcaacaaccaaatatactagcccaacagagataattccttgcgctacggctggataaccaactgtcttcagcaaggacgtcatgggaataatgaaagcaaagcttgaacccatgtaagctggtactttaccacgtgtaatcagtaaatgaagcagtgtaccgactcctgaggtaaacagggctactccaggattgaggccaacgagtaatggcactaaaacagtagcgccgaacatagaaaacagatgttgcaatgataaacctaaccatgtaaaaaagggtggcttatcatgtaaatcataaatcgcattattttgattttttgacataagggggtctctcctgcagaatatacttattttattataaacaaaattccaaaataatgtcgaaagattgcataaaaaaagacacactactcaatctatgaaacagcatatcttttatgaattaaattacttagttaatgtcttttttgatacgactgacaaatcatcagccaaatcatataccaatggttgtccgttagcaatttcaacattcaaaatgtcgtcatctgagatgttttccaagtgcttaaccaaggcacgcaatgagttaccgtgagcagcaataaccacgtttttaccagcttttaaatcttttgaaatgtctgattcccagaaaggcaatacacgttccaaagtaattttcaagttttcacccaatggcaattcaccttcaggtacatcggcgtaacgacgatcaaatgctgggtaagtattaccttgtactgtcattgtttcatcatatgagtccaacaatggtggcaaaacgtcgtatgaacgacgccagatgtgaacttgctcgtcaccccacttttcagcagcttcggctttgttttgaccttgcaatgcgccataatgacgttcattcaaacgccatgactttgcttctggaataaacaattgtcctgcttcttctaaagccaagtgcaatgtttggattgcacgcgtcaaaactgacgtatatgcttggtcaaattgaataccttcagcagccaaaagatcgccagcttctttggcttgggcaatacctttttcagacaactttgtgtcaatccaaccattaaacaagtttaatgcattccattcactttgaccgtgacggattaatactaacttagccatatgtgctaaactccttagtttgtgtttaatttaacgactatattataccacgttttggtgacacaaaaaaacacacaacttatataagttgtgtgttccaaaagaaattaaccctttgtgatgtttgttgcttgcaaaccgcggtctgaagtttcaacgtcaaatgtaactgcttgaccttcgtcaagagtcttgaagccgtcgccttggattgctgagaagtgtgcaaatacatcttcgccgctttcgcgtgtgatgaatccgtaacccttttctccgttaaaccactttactgtgcctttttccatgatatgtttctcctttggtgtgctcaccaagttttattgttcgtaatttaaataattggtactgagcgccttccgagaaaaacaaatcaaaatcaaaaacttttattactcttacagtgtaacacatccataaaaattagcaagcattacgcatattaatttaaatcctatgatgaaatcatttactatctagagctgccttaactgccttaacctgcatttgcgctgctttgtcaggatctttttgagctaattctgctaattgcttttgttgttcagcagcagcagctttttcagcatctgttttaggcgtcattttagcagatagtgattttgcctgagtagttgtcaaggcaatccaggtacttggtacttgataaatagtacgtcgatgcttcaaactcttattattatcagcaattccaaacaataatttgtaagtattgtttttataaacccaacgtgtcgtttttgtgaccttgtatgctttgtttccagcgatactttctcgtcgagaagttgttttcaaatctggctttgccacgaaagttttcttagcatcggaacttgttttataaatataaacattttctttaccattagttccaacaccttgatacaacagcataccaaatccttgattagcatcacccgctgtataaatttgctgttttttggtcgtcgtaactgctttcataccataatgatcgtgcatgtttgcaacaatgccaatcacagaaataattaaaccgataaacataatcagagcggttagcaaacgaataacacggttttctaacatcatatttgctaaaaagcctagcagcgcaaatactgccataattaaaataatcattttgacgcctccatctttgatggtgtgtttaccttaccgctgtgcaatgtaaatgcaataataacagctacaatcgcaaaggatgctgccagaagaaacgaagcatgaaaacctttcaacgtcgcatcaatcattttttgtgcccattctaacggatcttgcccttttaaggcagatgatggcttattattatctgttactgattgcatcattgaagccaaaatagctgttcctagggatgaagcaatttgacgcattgtgttgttagctgccgttccttgtgaagcagtctctggagacaaagcacccatagctgatgctgttagcggcatcataaccatggcaataccaaacatacgcaatgtgtaaagtgctgtgatatatatagacggcgtatcagcggtcatataaaacaatggtagtgtgccaataattaaaatagtaaaaccagtaatagctaaacgcttagcgccatgcttgtcatagaatgcaccggctaatggtgaaataagtcccatcattaatgcacccggtaataatgttaatcctgagtgcaaaggcgtcatgccacgaatattttgtaagaagattggcagaatcatttcaaccccaatcatggacatcatagctaaagaaaccaaaattgtcgtaatcgtgaactgcctatttttgaatactgacatatctaagaatggcttatccattcttgattgatgccacataaattctgcaataattaaaatacctgctactaatggtaagataacccaaccaaagtcgccccaaccatgtgttgataccatggcaaaaccgaatagtaacaatccaaacccaaatgtcgattcgattagtgaacgcacatcaagagaaatattcctagtaggtaaaacatcgtggaatacaaagaatgaggcaataataacaataatgacgactggtaagtcaattagaaatatagagcgccaagaattttgtaacgtgaaacccagaaaagtatgatctttctccaaaatccaccctgatagtgttggtccgatggcaggtgccataccaacaactaggccacccaagcccatggcttttccacgtgactctgcatcaaacagcgtcaaggatacgacctgcatcagaggcatcaagacaccaactgccattgcttgtaatacacgtgcaaccattagcaaccagaatgcatttgttggtgtcataaaggccaaaaaagttccggctgtaaataagctcaacgctgataaataaagcgtttttgtgggaattcttgtcgttaagaaggctgaaaccggcaccataataccgttagccattaagaatatggtcgtcaaccactgtacggtagaggcattaacatcaaaagccttcatcagtgctggttgtgctgttccaagtgaggtctgcatcagcatcaccgagaagacaccaaccaataagacgagcatcatagctaagcgattgacgcttttaccatgtgtatctgtaattgtatctgacatgtgtaaatcctttcattcgattcctgctttttacagaaaacactttgatactatttaacttcaaatgcttattttacgctttaacaaaaaattgtcaacatagttgacaataaataacagttattttaattcgatatcaaaaatacggtgttgtttatcaaaatgaacaatcacgtcagcaagtgatttcgtgggtaaaatatactgatccagatttttttgattagtgttttcccaaacttgcataactaactgagtaaattcgtcgatcggcattttggcgtaatcataacgccaactagagggatcatccttggctaaagctgtgacctcaagcgttcgggatagataccattctttgatatctgccaaatcagcatctatatatattttcaaatcaaaatgtttgggtggtaactgcaaagcaacaacgccctcaacgattaggatattaggtaattcaataatttgtgtctcgtttggatgaatatccgcaagttcctgtgtataaactggaatattgagtgacttttcccccgcacgaaagcgcgtgataactttttccaacagatcaagattgtatgtctgtggaaaacctttttgatcaaatagaccacgctcatggagttcatcattagacattaaaaagtcatcagtgctgatgactgttgttttgatattctgttggctaagcttatcagccaaatcatgtgcaaatgtgcttttgccgacggctacagaacctgtaataccaataaccataaatggcgcaacgtacttgcttttaatcaaattatctagatcaatcattatcgaacctcatagaggttttttgacacattatttagtagcggtgtcgtagccctttctgcaataattgtcagtcgatgcatagctcgcgatgaaacagtatacaatagacggcgttcactatcttccttatatcgtgttttatctgcatgccatatgataacggcatcgaattctagtcccttagcaaggtatgatggcacgataataacacctggagctagccgctggttttctgattgaatcaaagtaactgttttgtcattaagcgtttgtgacaaagcttttgcatcggccaatgtttttgtaatgattgctgttgattcttgttcttcggtgttttcacgcaattgattttctagcaatttcagtagttcgttctcgtcttgcccaatatagactaccggtttctcaccatctcgattaaacgcgtcaatgttttgaccgtctatcaaaatttcttttgtaaaatctgtaatttgctgtgtagaacgataggtttgcgttagttgaacattttcaacacgctctggcgcaaataaagttgcaaagtcttcccgtaaatggctagcattatcctttgtaaatatagcttggttcaaatctcctaagaccgtgaacttagccagtggaaaactaaacttcaagaaggcaagttggaatggtgtataatcttgaatctcatcaataaacaaaaagcgaatatcacgttcaccatgcttccctgtgattaagtcataaagatataaataaattgttgtatcagcgagggacatttgatgattctttaaattgctaatcacttgttcaacatgttcacgccactcatcatttgagatgccatacgcagataaatcaatatatttgtgagcttcacgtagaaaatccacaaattgcgcattaatatttaaaaagcgactacgtctaatttgttgtgccaaaggttttaaggcacgcgttacgatttgtttagccaagaactttctttcagctttttcactagaaaactcacgttcttgctcaccctgaccaagttgcgtacgtcgcgtaacagccgcagcatcaacctcttcattatcccccatgcgcacacgaccggcacccactagttcatcatattcctgctttgacagattttcaatttcaagatcaacccaatctttacgcatttctgtgccaagacgactgctcaatattcgcatcaacgtatctcgcgttgcttccaaacgttggctgagtttgtagttctcattgtattgataataaatttcagcaatacgctctttgggaatcaatggttcatcacgaaacacaatactacgtaacttcattcctccacgatttaaactgtcagcatatgctgcgacagctttgaacatcattaagctacctttagcaagagcaattttactatcggtcttgtcaatttcaaagcgttcttgcaatgtttcaacagcaatttttggtaaacgacgtgaagcatattgataaaatgtcatctgtaccatgttttgctcgcctaattcgggtaaaacttgatcaatgtagtcattaaacagttggtttgggctaaacaaaataacttgtccactagttagttttccgcggtaacggtatagcaaataggcaatacgttgcaaaacagcagctgtcttacctgatccagctgctccttgcacaaataataaatcggcacttgtattacgaatgattttattttgttctttttggatggtggtgacgattgatttcatcttcgttgacgactcaccattcagcgcgttcatcaacattgcatcaccaatcgcctcttccgtatcaaacaaggttacaatgataccatcttcaatttgaaattggcgtttcagcgttacatgcgccttttgcgagccatcaggtgtcaaatattcaacatccccaataccaccatcataataaattgatgctactggtgcgcgccaatcatagacataatagttgttctcattatcgctaaaagagccaagcccaatataaattgtctctgcttcgctactttcactgactgattcactaaaatctatacgcgcaaaataaggttttttaatttgctttgttaatgtttcaaatcttgcttctgctcgtgtttttgaactttcacgttcagcaagcatttgttgctgctgacgtactgacatggctgtttcgacaataccagaataggtgtctgtttttaaacgtacatctccccagctttttgatacatcattaatattccgattagaacgctttatctcagcttcggtatcaattaacgattttttcattttcttgagggttttgtttaaatactgcgtttcaacttgtttaattttatcgttcaaaatgcgtctcactctcttgatttcaatgtaataattatacgcttagtaatttcaaatgaacagcaaaatgaataatgaaagtacgatactattcaaataaaataaaatatcgcatataacttccgataaaataaagtataattcagttgacaaactaaataattaaggatatgattaacaaaagtagttatcaaaggtaattacttttgttaatcatatattggaggaagtatatgaaacctataagccacatcttctcagaattgtacgataaagtattgttgcaataccagcaacagtctgatagcaacgaacgctttcctaatctgtcttcaaatgatgaatattacattgatctcctatatacattggaaaatccaactgtaactagctttgcggataaggcaaaaatatccaaacccgctgctactcgaatcattcatcgctttgttgcagagaaatatttagttaaacgaccatcaacagtcgacaaacggacatcatacttagaattaagtgcagaaatgaaaataaattgcgaaaaaaatcgtcaattatttgatcaggtttttctagattcaatttctgtattaactcctgaagaacaaacagtgttacacaagattatgttcaagattaacgagaaaatatgaatcaaaaaaatattgaacagcgtagtctagtcattggttgtatatggctttttgcaatgggggttgcagcgcttacagcatatttttcaacacgactagaagcattatttgttgatgcatactttactttaatcacactaaccactggccttttatctattgtcatctcaaaaataagtacacaagttagcaaacgttttccaaatggtctgttcgttttggaaccgctgtatgcattttttcagtcattattgacaattgtattattgttgatttcattaatgactgtcagctcaaaagcctatcaatactttgtctatggtcacgggcaacttttaaatattgcccctgtcataccgtatgagattgtgatggttattctatcattaacactctcatggttctatcaattacaaaacaaaaaaatccacaatatcagtacacttctatcagctgaaacaaaaggagcgatgattgatggtgtcatgtcagccggaattggggccgctgcatttttcatcctattcattgataaaaagtccccattaagctttcttttatatactggagattcctttattacagtgattattgttttatttattattagaatcccgttgcgtataatgaaaaatgctttgattgagattagcggcggcctaacacaagatcaagggataaaatcattcattgaaagagccattcaaagtcacctaacaaccgatttttcaattgatgattgcaaaatctataaggttggtatgtcttttaaagcttgtatatctattagcagtcgaacagatatggtcgataccaaaaaattgacaacctataaaaagaacatcttaaatgacctctctcgtaaaatttctttcataaatattatctttatctattcaaacattggggaaaaaagttaattttcatttataaaaagctgcggttacgcagttttttgcattctataagaaccctttacataactttgacgatataacaatatctatcaaatatactaaagttattaatttggaggacaacattatgcaatgggctgctagaactactaacgtgaaactatcgagtgaaaatcaaagtacatttgagaccacagacagtgaaaaaaaagtacttacattgctactaagcattggattcgtgactttattgttcgctacattttttgataaaaatgttacctctgcagtaatggaccagaattctatatttggtaatattttccaaaattacgctgatcaaggcgcaggaattgttttattcactgcctttgagattattgcctggacaatatggcgacgcgttcagggaaacattttgaaatatgttatgacaggtggcgctttgatatttgcctttaatcaaatgctagcgatattgcaagatatgttgagttacacgtattccatgctcaataatttatcaaaaggaattcccatgggcgttgcaaacaatacttcggcagtggcaaactatcctgaaccgcttcgttggagcgcagccattatcttaacaatattactgtcatttgtattctttaattggcttaaagataaaaacaacgccgctattagctatctactcaatgctgctttaatcggaattgccgttgttttcatcgcacaaacaacaatcggcgatatgaaagcattgtggggacgctttcgaccctacgaaatgacaaccatttccggaaacacaatgagtgaatttacaccttggtatcatttgaacggtgtgaatggtcataactcttttccttctggtcacacaatgtccggctggttatttttatacttaactttctttgttcctcgaggaaatattagtttgcaaaagaaaatgacaatttttgggattgcaatgggtattcttaccggtcttagtcgcgtacggattggtgcacattggctaagtgatgttactgtgtcaagcatgttagtcggtctcatcatcttcatggcgagtcgtttattaacagcacattttgttgaaaccagctcctcgctgaattaaaataatcgctattaagaatcgctatgaaaataaatcacagcagttctttttattttcgctcaaataaaattttgttatccaattgtgtactcgtacttaaatacccaagtatcattgacttgtccgaatgaagtaaaagacgacctagtgacctcattaaagccatttttctgataaaaaacactgttgattgctgtattagtaatcaaacatagatctttaccacctcttttttcaaccatatcaataatttgtgatatcgttcttgagcctattttctggccttgatattttggtgaaacaaccaatgtatctatgtaccaaaaattttcaaattcttcgggcatggcatcatctgattgagatagattttgcatgatacgtccggctattttaggagaacatttaaaaggtagttgccatccaccaaccttaacatacgtccaaaaactaatctggtgctgttgtggtgctttcaaaataaaggaagcaactatctctgacccttcaacacaaacgaaacaatcttcacgcctaatatttgctagcgtatttaaatacaataaaaaatatagtgcttgctgtaattgaggcttgtcagttgagacattaaatagaggataatcatggaaagcatcatatgtcaatttagtaacatgatccaagtcttccagcgtagctgttctaataatcattctattctccaatatttttaaagtaaactgtagtttattatctcataaacccaacaaagtgtcgcctttaaaaatgagattattgacagaaacacactttagcgtaataatagcattaattaaacaacgtttattaattgaggggaattttaaaactatgcaaaaagatgaaaaagttgaaaccatgttggatcaaatgagtgtcgccttttctgatgaggatgttaaaaatcaaccagaactacgagaaatgattttcaattacgcacaggagttaactaaaacgcaaaataccggcttagtggctactaaaatggttaaatctcttgttcaatactattggataacaaaaactcaattacccgaagcagcaatcaaacttcatcatcaaatcaaaagagatgccaccgtgtacgacggcatcgcgatgtctgccatgctgttacctgtatggttctaattacttgggtcatttatcgttagcttaaaatacaaaaagcttctatataaatactgactgcttgatcagttatgcatttatacagaggcttttttacgtttttaattttttcatcaaaaaataaatatttaaccccattttgtaaccaattgtccccttattcgttatatatataacaggagaaaataatggagattaatcaatatgaaaacatagttctaaatattgcacaggaagttgttcgatttttagtcaaaaaaggcgctaagacacaggatgctgaagatattgctcaagacgtaatggttaaattaatcgaagcaaatattgttttagaagagaataaactacggccatggatctataaagttgcgctatcaaaattttatgacaaacatagacgaaataaaagatatgataacatcttgcatgaactatatacccatacggaaaaatcaaacacagactatacaaagttaagtgataataagttaccttacgaagtactcaatcaactcagtcattatcaattacagctcatttatttaaaatacgatgaactgcgtagtattgaattcattgctaaaaaacttcattttagccaagctaaaattaaaattgatttatttagaacgagaacgcatctcaaaaaattattggagaaatataaaaatgaatgataatcaaacatttgaaaaattaatcaaaaaaaccaaaacaaaaaatacactcaaaggcatacttattagttctttatctacaatcatcgtgtttcttatcattcttgtcggcgcaaatttatttgtatccaatactatgagtaagcaattaaaattacaaaatcaaaaactaaatatcgaaaatatcgctttttcaccaaatatattcacaactcgagaacatactactgccatcgcatggacaaaatcaacaataactgaaacccggattaaaaatattgatggctatcatatctactatcctgaaaaaactttacaatttggtctatctggaacgcagactttctcccgagatgacgttgatgtttataaagccaacccttcaattattgctaaaaacacgaaaacacaagaaaaagaaccaatattttttagtcgttctgctaagtcaatatataaaaattcaaaaaaactcacgttatatacaccacccacgcatgaagcaaaaacattatctacaatgaaaaacacattagcagaagtggctttaacattcgataaaccttattcttatagtgaaataaaaaaaatgattccagataatgtcatgattaattattattgggtaggtttcggaaatagtaatacatcaacaatagcaagcgctggcaattatatcggtttgaatgctagcgatgatgggaaaggttctttgcaggaaggtagtacaaaaaaaaatacctacactggctacaagggattgaaacaagcgttaactgactcaatatccttacaattggcgtcgcatatttccgaaaaaaactatatctcatcaattaaatcacaactatcttcaaacttaagcaccgcgaaattcagtggtgttattgtcactggtaaaactgataatctgaaaagtctagatgatttgaatttcgtttttgcaagcaatgtcggattaacaacaccaattgttccttatgaaaccccattgaaatagattaccttaaataataaaaagcacacaattctttattaaaaattgcgtacttttattaaaaatacattaagtagctatataataactaaaaagatgtaataaatgtcaaagtaccaagcacaactcctgctgtattaggaataatcaatatataatccctcttagggtcattagttaatccataaacaacccaaagcaaacaagaaaaagctgctacaataggctgccatggctgccctttgtcaccggataagtttgctattatctgtggaatataggctataaaaaccattgttccaattaacgctccgatagatccaacaaaattatgtattctatttttcatgtattagtataactccttgatatattataccattgattaaaaaaaattagtaattaacaatattttgtaatgaaacctaaccaaaaaacatctttcacaatgaaagatgttttttatgattattgtaataattgttcgtccgattcaatgtgctttactttaccagtagagttgcgtggtacatcagggtcgaagaatatttttgttggttgttctggtttagataaaatttgtgtagcatagttttcaatttatgcaggattcctttatcaagagtaacaattattagggacacttccgcgactaatcattgcccaacccgcccaataacacatataaatagtcatcctcgtcttatggcaattttaatttatattgttactactaaaaaacaattacaataaattgaatcagctcaataattcttgcaactgtctcttactaactatctgttatctagaaaactacacctagcccgattaatactctgtagatggaaattcaaaaaaattatttaagtgcttgaataatatcaggaatcgtaccaccaagaattgctaatatcggtatagctgcccaccaataagccgctgcaaactcccagaaattcatgtgctcgcttcttctacgaatatatttccccttacgtggatcaaatacaaattcacttttatctattttatcctcgatattgtcctctgttggttcaatgcctaaaacaatcgtatcaagcgagcaatcaaatatttcagccaacttaattaagttgctcatatctggggttgcatctccagactcccaacgagaaacagcttgacgcgatatgtacaattttccagcaacatcttcttgagacatgtccaaattagtgcgtaatttttttaactgtatctccataatttactctcctaagtgtatttaataccttaattattcaacagaatcttgtaaaacgatagcaattaaatcagtgaaaatagcaatctgcaacataaaaatgcgcaaacacagattgcgtaagatacatattatagctcgataacaagcattaagtaggttgcgcttattttttcaggacttttgcccaaaagcctttcgatttctctttttgcaattcattttttaagttatcaatttctgatacaaactcagaagtgtctgaaacttcaagatattgctgttcttttacgtcaattttatgttgtaagtcaagagatagcgtttgttgctggtcgagtaatttatgaagttgtttaatttgttcatcttttgtcttgagttgttctgacaaagtcttgacactttctgaaacagcatcagaatgattattatcaacattttcaggcattgactcgagattttttagttcttcatgtgtaaattcacgctgactaggattgatgttccaagcctttgctctcctataatacgtagctttactaatatcaagtttcttaagaatacttgttagtgttttgaattctactttttcactctcagccattgtctgatacctttctgataaacattgaatactaacagtatacctttatcttgaaaaataggaaacagaaaacaaaaaagtcactttaataaaaagctttaaaaaactatctacttaaaagttctaaacgccgttgttcgaaaatggattaattgagttgcgcggtccaaaatttttcttgtcatactttaaatactgatcctcactacctatattactgcgatacaaagttggtacttggccctttgtaattaatcgagcacgtttcacgtaggatcctttatgcaacacaacagcataattatatcccttaggaatagttccaacttgaaacttcaaccactctcccgcaccaaaaatgtcactatatacataagcatctactggttggggcatatccaagaccacttttttagtcgtggttttcccattcgcatctgtgctttgttgtgttcccctaactttcttagtggcaactttttcaggtagcagtgcgtagccatacgtttcttttagaaagggattaaaccggtcaattaattgattttgtgtcgcccgcccataagttaatatagcgataaaaaataaaaacgcacttgctaaaatagctagttgccacacaattttcttgtatctttttcccgctgtcagttccttattaatgctatcaatcatatctgtcccctcttcttttaacgttgtatccaaagaaaaacctaagtaatcactcaacgtaaccaacatatccaaactcggataagtatcattattctcccaatgtgacaccgtttgccgcgtaacatgcaattctgtggccatttgttgttgtgttttatttaatgctaatctacattcttttaatttttgaccgagctccatgtcgcttcccctttcataacaaacttaagtatacgaaattgtcacgtaaagatcgagcaagtattctttaacatgttgatatgagggcatttcaatacaatgatagataaaaagaatgttcaactcatattgagttgaacactctttaaattaattctcgacggttaattcttccaaagtaaccggtgcgttagttagtaatttataaccatctttagttatcaacaccgtgtctgaatgtcgataaccgccttgaccttcaaaataaattgctggttccaccgatacaaccatattttctttcaaaactgtgtcattacctaatgataaagttggctcttcatggttatttaatccgatgccatgaccaggtcgatgaagaatgttagccgtaagatgctggtcaataaggtaatctcgcacttttgtctctacttcagatgccttaacaccaggtcgcagcatatcgagcattatatttctagccgtcaccatttgattaaagtgtaattcttcttcttttgttggtttctccatgaagaaggtacgttcacattcggcagcatagcccgctaatctaaacacagcgacgttaacatttggtccatgatcaactgttgccgccatatcaggaatactatggggcatgaaactataagttgacggccatacaccgtttgttactctatttgtgagactaaaattatccgcgatttctttaccaactaccttaaacggaaggttataaaggtctatcactttggagtcgttattcacttggcctaacgttgcacgaaccactcgactacatactcttgcagtcgttgaaattttgtcaatttcgtaagcactctttatttcacgtaattttttgattatatcatttggttgccaatctactgtcggtgcctttgcagttatttctaaaagcgcattactttcgataccaattttatccaacccgtcaaacttttttgtaactacctcgtaccagttttgaccaacttcagacgtaacatcaaaatacgtttgaatatcataatcaaaatagtcaacatcaatatgtgattcttctaattttggtaccagcattaaaggtttcttatctggataaataattaagaaaaacggccgttgctcagggctataatcaatattggtcagataccatatgtcctctacatctgttactgcgtatgcacttaactctttttcttgcaagaatctttggcaattttggatgcggttatttatttcatcactgagtatactcataatttcctttttttaaatattaactgtgcttataattaatcttcttgatttttaattgcttgaacatatagaaaccaatcataatcaatgtaaaggcaacaaatatgccaaacataaccatcacatcacttttagcggatccaccaatcatcaacgtttctcgcagtgcattgactgaataagtcattggcaaatatgggtgtatggcttcaaagaaaccatttgacaattgaattggatatgttcctgcggaaccacctaattgaataaccatcaaaatcattgccaggaatgaaccaactttaccaaaccacaagttaagggatgttacgacattaataaaggtaaatgataccagaatcagtacccagaaagttgcgacatagtgaactggtttgatgccaatcatactaatagaaacaaagtacataattgctgcttgcaaaaatgcgaatggataaagcacagacattttgcttgcccaccaactaatagcctttttaggatactttagaggtgtcactaaatcaaacatcaagttaaaggcaacggcaccaacgaacagtgccactgacaacatataaggtgccatagctgtaccattattaggaactttgtctttttccacatgcttggtgcttgctggggtagctaattgattgtaggttaacttatttgagttaattttattaactttgttgtttgcttgacctagcttgtcagcaagcgttgcattcccatctttaactttcgtcagcccatcgccaagttttgctgaaccatcagccaacttagcactaccgtctgctatctttgtggcaccactagctaattgagtcgacccgcttaacaacttgctgctattagcagccaatttatccagtcctgacgttaactgactacttcctgacgataactttgacgttgctgaacctaaagcaggcatcttttcatttagtgatgataagccgctgctaattttttgggatccagcatttaacttatcactgttttgtgacaacttttgggtaccatcgctcagcttagaactaccgctagctaagctttcaataccactagtgagtgagggtacattcgtattaagttgttcaagcccctcttgtagctgtgttgaaccactaattaactgtgctgatttcccgctcagttgtgacagcccactagttaattttgttgccccagtacttaattgcgcagttgaatcaccgaccttattaagtgagccaaccaaactgcttatgccaccatacagcgtttttgtatcgtcactagtcccataactagtgtttagtgtattcacagctgattttaactgtgacatacttgtgttacttgatttaattaatgtggttaagttagtctgtaattcacttaaatttgttgttgctgatttgagtgaatcattaatgtcatctgttggtaatagtgccgtttctaatgcactgacttgcgtgtcagttagcttttgtgttttagccacagattcgattttgctttgcgtcccgctgatataattgctaatcgtagtaacgtttgctgcaagactactcatactacttgttaatttagtaatttgctcagtattttgattactgttgtctaacgaggtcttcaactggttcaagcctgtctgaaaactttgcagccctgtttgcaattgcgccattttgtttttggcatcgtcactatttaaagcttcattcatttgtgtcaagccatcggaaactttttggcttcctttatacgcttcgtctgttccggttgtgtatgcactaacgcctttggtcaaagaactcgatccgttagttaatttattcaccccggtagctaaattactactaccacgagctaatttttgcgcaccagtattaagagcattggcaccagtattgagttgactcacacctgctgtatattgctgcaaaccactgtttaaactcgatgatcctgtagataattgtgaaacaccattacttaacgtaggcattttttcacctaattgtcccaaaccagcagttaactttgagcttcctgcatcaagttgactcacaccactaaagtattgtgataacccgtctgtcagtgtattcgtaccattactgaaagttaaaccacttgaagcaagtgtccgtagatttgttgtgaccgtctgatttccagattgtaattgttcagttccatctactaactttttgttaccgttagccgctgtgcccataccattgcctaacgttttaatttgtttaaacaatgtctcagcataggtctttgtcacttgtttggaaattgtgtttgtaatgctttcagccgctgattttgaaaactttccagcgataaaactgtgccccgagcttgttgtatagtgaattaacatctttttgggatgcgcgtccagtaatgttgtcgcatttttagaaaagttctttggaattgtcatgaccatatagtacttgccattggacaatccttttttagcttctttttgcgatggaaaactaaacttcatcgcatctgaatccgctaaattatcttttaacttagctcctactgctaatttatttccttggtaatgcacagatttgtcttcattgataactgccacgggcaaatctttaattttgccataaggatcccacatcgatttcagaaacccaatcgcataaattgacggaatcaacacaatagcaattagaacaaccaccataaatttatttttccatatttttttccattctattccgagcatgttactccccttttttaacaacgtgttgctttttttgtagctatagtttatattagcattggttatatataaatcaatgtacaagtactaagggatttgtctaattttatgaggagaatagtatgaatcggcaggaaaaaaataaattaacacagcaacgaattatggacgctttcgtgaaattagtgagcgaaaaaggcttcaataacttaaccgtctccaacatcacacgaaccgcaaaactaagtcgtggcactttttatatttattatcttgataaatacgatgtattagaaaaaattgagacctatttactaactaatatggaaaaactaatgcaaattaatatagataagacaatatcttggctagacgatgttgataataataaactatcggctgagttagatacctattcaccgtatcgtagtttcattcagtcttttgattttctcgataaaaaccgttttacgcttaagacactcctctctaagaatggtgattcacaatttgtttacaagttacgtcatttgattgatgaacaaattgactcacattacaaaaatatttttaaagatggtaatgaagttattcccagtgactatacacatgatctattaattagttcgctcattagcattattggtcattggttacaaaaagatgatcctgaatctccagctgaaattgccgaaattttgattagaagtcgtatactggctgcttaccaggtaaaataatttttgtaacacaaatcaagtctcagtcatttttccctaaagtgacaatgacaccgcaattaataaaacaaagagaatatgtgactagcatattctctttgttttatctttattttttcaaaatcaatgacacggattataagcttagctcgacgaaatcgtacgtttaatggttagcaacagtttttctagttttactaaatcattaatggcagttatcgatactctaataaaatagttgttatttgatttccaaccacctgcttgaaactgcgggctgtacaatacatgtattcctagcttgtccagacgctctttcacttgtttaatattaattgcagaatctatcttaacccattgaaatggactcaacggcgcctttgtttcaaagacgttctcaaataaagttaaactagtttttatctgcttcatttggctatcaattgtctttaaaacaaagtcatggttaattaaatacttaataatttcaaaatctaaggttggttcctgtaaattaagatttgtgaatgaatgctttattttctgctcaaactttttattaaacaataccagcgctacgcgaattcctggagcaactattttagagaaactagataagtagattgtatgactcggtgccaagttaattatggctttcgttttttcaacatccaagtatcgtaagtaatcatcttcgatgattaaaaaattatggctaatgcttagcgctgctaacttttcgcgccgcgtaatagacatggcaacattagtgggattcgaccgaaaaggcatgacataaacaccagcaactacatgcgttgtcaacatgtcttccaactgatcaagcttcatcccctcgtcatcttgtgaaattgacaataacttaatatgtaacgttttagctaattcaataaaattagaatatgtgaagtcatccacaactatagtgtctgaaggtttgaataaagctgttaaaatgatggcgagtgcgttctgcccgccatttgttattagactgaccatatcgtcagatacatctatttttaaatattcaaaccatttttgtgttgccctagcataactctcatctaaggatgaatttgtgaaataccgtagtaactttttaacgggaatatttttaatagcttctttcacataaaattctgctgaactattttcaactgaagttacattcaaaatacctaaatcatttacgccttcttttccttgaatagtatgatcagaaatgccattaggcgatataaaagtacctcgccctttttcggtatataataagccatttttcaagccaaaatcataggcatgtgtcactgtggtgaagtgaatatccaaaaaatatgacaattcacgttgcgagggtaactgatcgtgtggcttaaggacacccgtcagaatatcatcatataaggattgataaatacttttatagaaaggtttctcaagtggtaacttgctcggtacccatgacaattcataatcattcatcccgttcagcctcctaaataaaatttatcaacatcaacacctgtaaccactaaaatatctgttcattaaaaatcagtatacactaatctatgcacaataaaaattatatggcatacaatttttttattgtatgcttatttaattgctggtagccttatacttataaattgtccattgagagagtgaggttacattgaatgatgaataagttatcaaagagtgtgcaagcaattatattaggcgtgatagcggcttttttcttctctcttacatttatatttaatgaagttattgctaataaaaatgggttttggctctggtctgcctccttacgatatttatggatgctgccgatgcttgctttgatattcattccattgggcggatcctttaggcgagttaaccaatcaatacgcaaacagcctctatcttggtgggtctggagccacttctgttttgttctattttatgttccgttatgcctagctagtacttatctacctggttggctaatcgccagtgtttggcaggtaactattgtttgtggtgttttaacaacgcctttactaaatatcggtaagccttcaaaaaaaattccttttccttggcaaagtttaccttggatgttcattattcttttaggtgtcttcctaactatcctccagtacttgggtgccattcgcatttctaaccaaatatacttatcaatactagcgatagtggttgcggctatttgttatccacttgggaaccgaaaagttatgatgactgcgccaaaagttaccggtctcgaaagaatgtggggcatgctactgtgtacctacccaacatggattttcttggcgtttgttagtttctatattagtggtgcccctagtgccaaaacaatggtgtctactcttttagtggcactattttctggtattatagcgaccgctatattttttcatgcaacttccttagtattccgagaaatcaaatcgttatcgaaggttgaagctactcaagcgatggaactcgttttttccatcctattaagtgcaatctttctccatcaccccttctcactcagttgggaactcgtaggtgtcctagtaattatagtaggcatactaggaattagtttgcgtaagtaatcttccctagttatcaaccacagcacttttttatcaaagcgcaatagtaaacgatggcgttttagttcaacatatagccactattcgaatcaaaatagtggacactaccgtccttgaacttgatagaatagccctttacttgtgtaccatcagatttaaaataataggtatgtccgtcaataatctgctcacctgttaaaggtaccccattgctgtctaagtacttccaagtgccatcattcatttctacaaaacgattcttaatcgtactagttgcttgcgactgattagtatcagttataccaaaaggatataatacggctgaaaaacttttttcagaatttgtaccattaattgtagcggttagttctgttgcacgtgtactgttaattaagttaccagcaaaacatccggaaccaaccctttgaatattagatggtaatattatatttgtcatttgattatcaatgaaggtaccatcccccattgttttcaaagtgtttggcaaattaatactagtaagctgattactagcaaacacaaaatcattcaatgctgtcagactattatttggtaagttaacttttgctatattgtttgacgcaaatgcgtaccagccaatacctgatatatcagcatttaagctgtttggtaaagttaatgtgtttgaaatttggttatcatagaaagcaaagttaccaatctgtttcagatttgttgctttggagaaatctacgcccgtaatgcctagtgatttaaacgcattagcagcaacctttgtcacattcgtgggaataacaatagttttacctagtgtggcgactcctgatttaacacctgtcactattgtggaattattgcgatcataggtaaaactttgtgggttgcttatgctaccagatactcctttcccataagattgatgcttcaatgcatattgcttagcaacggcatccgcttgtccagtattttgtccaaaagtttcataaccataccagcgaaccggatgattaccgctactatctaatacgttattgggcaacaccacaacatgtgaggcttgatttccatagaaggctccggagccaacacttaaactattcgtattttttatcgttgttagatcaaccgtctttaagcgatcaccggcaaatgtccaatcaccaattgatgtaattgttgctggaaaggtgaccgatgtcagattaggatttttggcaaaggcaccatcgttaatatgtgtcacaccactagcaaacgtgactgagctgatcgcgttgtcatagaaaatataccatcctaaattattatcatttagattaggatactgcacagctgttaaacgatttttagcaaaagcaaaatctccgatagattttaggttagttgctgaactaaaatcaacactcgcaatgccttgattataaaaagcagtgctagcaatactggtaacattattcggaatcacaacctttgcacctgtatgttgtgatgaattgtccgaaaaaccatacaagactccattttttattttgagagacggctgtggtacaccatcagcatgaacgatcgtgctattgatacacaatgcaccaccaacaatcaacataataaacatcattctgatcaaaaaatatttgctcccagtttctctaaccgcgtcatcgttatacatcatacattgattcctcctctacccattccgtactgcaataaaactccttcacaacatgttttacgatagaaaactgactaagcactgttaaagctaaatacaacatcacatactcagaattttcttatatctgcttttattataaatcacattattcatcaatacatctttcagcaattgataggttaataatatattaaattaatatattttaatctgttgctatatttggtatcattaaaatatattaaatacgaacgtgcaataacttattcacgttaaaaggtgttgacaatatggagtcgcatatgattgcaaataaaaataactaatctgcatcacgtttgaattgttgatgcagatcataaagctcatgacaatttaaagaagagagatcaaagcagacatgtttataggaaaaaaagtaaaactatcacactatcatgacggcgacggtaaaaaatttgctgaatggcagtgggatgatgcgttcaataacccattatcagatgatatgattcacccccatactgctgaggactgggaaaacatatttagacgttcatctaaaagcaaagaaaatgttgaatttactgttagaaaaacagagaataatgaattggtcggatttgttgccttgtttgacctcaacatacgcaatcatactggcgaattagcgattggttttcctaaaaaggaagatcgtttaaaaggttatggatctgaaaccttgaggttaatcttagattatggttttaacaatttgaatatgcataaaattaagctcaccgtctatccatttaacacaccagccgtgaaagcctacaaaaagaatggatttaccaaagaaggtacctttaaaaacgaagtcttctatgatggaaaatgggtcgatattgaccattacgccatcttccaaaatgactggtatacttcccaaaatgagtatcaatgataatcatggataaaaaacgcgaaataacataatgttatcccgcgttttttctatctcattataaatatcgcaattcagcgttaatacatcttaacaccaaatttttttgttgtgatacaactgctaaactacttttttgaacaattttccctttgcttatcattgtttatccgcggcctgacaacaccaacatttaaagcaagcaattacttgcatgctttaaatgttggtgttatgataactcttggtaacacatcaaataggttttattcggataccaaatacttaaacttacttacaacgaacttttgatttttgatacttatggaaaaggatatacgcatgaatagacaagataagaaaaacttgaccagaacaaagattaccacagtgtttataaatctagtccaccaaaaaggttttactaatacaacgatatcagatattactcaacaagctggcctcagccgtggtacgttctatgtatattttcttgataaatatgatctcttggagaaagtagaaaataatttattaaaacacattgaaacactttccaccataacaattagtaaaacagtttcttggctagacaatccctcaggtgatatactatctacgccctcctcaccatattttagtttgattaatatattcaattatctaggtaataatcgctttttctttcaaaccctgctatccgaaaacggtgataaacaatttatttacaaaatgaactgccttctcgaccaattgtttaaaaagctatacacaaatactagtgaccatatattgcaagccttaccaagtgactacacaattgagttattgaccagtagccttgtcagtatcattgatcattggttacaaaaagctaatcctgaaacgccaagcgatgtagcaaaaattttaattcaaagccgattatttgctgtttatcaaccagcataattagacttttcttttcctatactacagtgactcataaaaagctgagctccacttttactaattctatattcgcttttgatgacatctaattttcatcacagttgattttttctcccaacaatgtcatttatatttgatcgctttaaagttataatagtaagcaatgtgagggaaaatcatgaaaagagttttattaattggctcaggcggtgctggaaaatcaacgttagcacgcaaaatgagcaaacaactaaacattacagcttttcacttagataagttgttgtggaaaccgaattggcaaatgacgccaaaacctgaacaagccatcattgttaacaatttagtgcgtcaagatagctggattattgacggtaattataatggcacactagatattagagttgctgctgccgataccattgtattcttggatagaagtcgatttgtatgtatctatcaagtttttaaacgtcttctgcagtatagaggtacctcacgtccagatatgcaagacgattgcccggaaaaaattgattgggattttctcaagtggatttggcaatttcccaataaacaaaaagttataatcatgaacatgtttgaaacgatagatcaatctaaaaatattgttatcttaaaaaacaaaaaacagatagaaaaatttttggatcaattataagttttacaaaaaacgtacaaatatatgtaatcaaaacaaatgttgaatcaggtcgctcaaataatccatcatactttagaaagaacgctatccgatgaaatcatatgaaagcaaggccgcattaaacgaggccatcaaaaccaattataaaaagtacattgatgaatttacaaatattccaaattcacttagcaataaacggatacaagatgttgatcgcacaccaagcgaaaatatttcataccagttaggatggattaccgccttattgaactgggaaaaagatgaaatagctggtcaagatgtctttgtgccagcaaagggttataaatggaataatttaggcggactctatcaatcattttatgatgattatgctgacctttctcttgaagagcagatcaacttactaaacagacgtgttattgaactttgtgaacttgtaagttctttaccagatgacattttatttgagcccaataagcgaaagtgggcaactactccagcccaatggccagtatggaaatagattcacatcaactcggtagtcccttttaaaacttttagaaccaagattcgtaagtggaaaaaattagcattgattaaataaacaaaaagccatgataacatatatgttatcatggctttttttactataatttaacgttcattttgatacaaatcaaccaaccgttgccttagttgatcatcataagctgttaaatacataccatatttgccacgtttaattaaaacattcaaaacattagcaataaaatcttgatattctttgcttgtaaatttgatgtccttgcgcttcttaaaaatctctttatgtgagtatttttctggcaaaatagtcatgctatcggttttgtcatcatagccaaatgatggaccaatgatcatgcccacataatttaaatcaaatccttgtaacgtataaattgtgcctacttgtgtaatagacgattcacgtttagcccagtgcgtacgttgtggatcccattcatcccaaggtagagaaaaagtgtccatctcaacattatgacgcccatcgatgcgtggaaatccagaagttgcgactacacgactcaacccaacttcgcgatttttagctttaacttcctcatataaatcccctgctgttgagaatactttaaagtcaaaatcactattacgaggaaaaggcatcaatggcttttgtgctgttaagtcatccatccattgtacctgttctgaactagcaaccatacgatattgaaaatccatatcaaattgtcggtatggatgactaccaacggtctgacgtaataaatcttgtgaccagtacattttagattgaaaaacttgtgcaaaatcatagaccaccacaacaattttggctaagttcattaaatctgtgagctggttctcacctcgatagtgtgcataaggctctggttttgaatataataaatgtgcctcatctacgaaaataacatcatatttccaattgtttttctgggcacgattaatgagtgctgtgggacgcaagatatcattttctttcatgccgggaatatcatgggcaaggtcttgataagctttaaataattcgggatgattaacaactaacgcggttttataacgtttatccgtcatatattttgtgactaaattcattaaaacaactgatttaccagtgccggcagccccttgaataaccgccacagcatgctgattccctttaatgctcttgttgatataactgtttatatttgtaatggtttctttctggttatcagataattgatcaatcatgaactgatctcttaaaattttattcattgcgattcactcctattgtatttattatacagacttagtaaggaaacatcagattttattgttattcccatcagcttcatcatgttaacatttatttaaggtttttctaatagtatttgtgtccttttactatttgatactatataagcaaagtaaactgttccaaataccaacgtgcaaatacttatccacgataaaagatgtatcaacggagttgcattatgactgcaagtaagatgaactaggctgcatatttctttaattgtttataggaaactcactaatgcatattaaagaaaagagaaaaacatgtttataggtaacaatgtaaaactatcgcattaccacgaagaagatgggaaaaagttagctagttggcaatgggacgaagattttgtaacgccgttagctagtgatatgattcacccttataccgcggaagattgggaaaaaatatttagggatgcttccaacagctacgaaaatgttgaatttactattcgaaaagttagtgatgatagtttagttgggtttgtcgatctatctgatatcagtgtacgcaatcattcctgcgaacttggcattggcttccccaaaaaggaagaccgatcaaagggatatggcaccgaagctctatccttaatattgagttacggttttaataatctcaatatgcacaaaattaagctctcagtataccccttcaacattggcgctgtaaaagcctacactaaagcgggattcgtcaaggaaggcacagccaaaaatgaaattttttacaacggcaaatgggttgatatagactattatgcgattttccaagaagactggtatgcaagacaacaataaaaaataaaagcactcattgagtgcatacataaacaagttaacgtgtatgactcacgttaacagaattaggagaatgattatggatgagaatggtaaaattgtacctgttgagattaaaggttggaactggggcgccttcatgtataacatattttggggaattggtaacaaaacttatttacctttactatgcctaatccctttatttaatttcatttggatctttgtttgtggatttaaaggcaatgaatgggcctggcaaaaaggtgattacacagacgtcgaaacatttaaagctgtccaggccacatggaatcgtgctggattggtgcagtttattttgacaatcgccatattagtactatactttttacttttcgtggttcttttctcatcagtcttaaatcaaaataactattagtagtctcatcctatttgatgtgcttgcacagagaaaaatcaacaacaaattttaaacccgtcaataactcgtttgaaatttataggaactgaaatcaaatgatgaccactcaagacaatattcttttaaaaaccgcaataaaaatgagacatgaaaaagaatttaaggcgtccaaccgtatcttaaaaaaattagatgccaaatatccgcttaatgccaatattcaatatcaatatgcttggagcttcgatattcttggacaagaaagagaagctgtccctcactactatgcagccattgataacaatgggctagaatctgtcgatttagaaaacgcctacttaggtttaggtagtactctacgatcaataggttcttatgatgaatcattagatattttatcaaaaggtacggaattatttccaacaaataatgctttaaaagttttcaaagggatgacactctataatttaaaacgctttaaagaatcctcaacaattttactgcaatgtcttattgagacaagtgaagacactgatattaaatcatatgctaaggcgctaggtctatactcacaagatctagaccagacattttaaataattatcaatcatcgcaattaaaaaagccttaatgggaacaaagcatgaaaataaaactggtaaatagctgctgttccattacaaataacttgctgctttaatgcgcatataaaatgcaaagaagaaaaaatatgagcagaaaaaatataaaaacacgttccaaaaataaaagtttttatcaaagtatttggattaccacgctaataatagtaattgtcgtcattattggcttttggcaagtttatactaggtattctggtgatttggttaaaaaagttgatacaacctcatccaaaaacactttaaaaccgcagtcaatttttaaagttggtgcgacagcagaatataaagatattcagtttaaagtaaatgacttcagtttcatagatggttaccccaaaattgataaattagctgctggaaatcaatttgttgttgtcaatatgaccattaccaataacagtaataaaaaatttgattatgattcatacttttttcaccttgatgacaatggtaaacaaacagatacaacagagtcttcttacaacgtaactgcttctttagacagcggcactttacgtcaaggtgaatcaacgacgggaaaccttgtgggacaagcaaatacaaatcatcaactaaggttaatttaccaacaagatactaatcttaacaaaggaaaaataacttttaaactgaatcaagaataaggtttaaaactgaaagtaagaaacagctcaccttccccttgctactctgactacgtatcaagtggactatattaaaacactaataaatatcgtccagcacaacgctataattagttttaatgcctatgcattaaaacttcttgcttgacctctactttgacgagaaaacagaaagatatagcaaaatttatgacttcatggcgtacttcggtatacctgcgtcactcgagagtgctgttttgaaaacatataacttaggtgtattttatggatttattaacaacgttcccaatggctatgagtggactaacatttttaatagtaagtaaagataagaaaagtaaaaagtatcgtgtggcgggaataatgatgttattggcaagtttcattagctttttgacttactttgtctataaatagaaatccacctaccatcagtatgtgacttaaaacgaaaaaaaactgtttattttaacaaggggataaactctatgtgtcgcttccctattgcataacagcgggggaataacaatatgcaaaaagccactatttttagaataattgccacagtaggaattttaggaacagtcctatatgaaattgtgactaataccaacacgttatatataaaaattgtccaagcagtttttatggtaatactatggactgctcttgcggttgatagataccaacataataaatcgaagagagaactaaaaaaagatttatttttagtaggggtgtttacattactaagcattgcaataatatccttttttagataattagcctagccatattagcaaatactacgtgcagaaccacgttaaaagcgtaattggggattaaggatgacaaaaaataaacaagaattaaagacgcaaatagtagcttatggttggcaattatttacacctgaaaatacaatcgttatggataatgaccagggtaacatagccattgaggatagttctgataattttaggggtggactatttatagtgttaaaagttagcgaaaatgaagttacagtagaatctagcggcatctttgaccaaggtgtctcaattacgttagacaaaaagattgtcattaaacgtcgccctgacattgaaattaatgattaagtgacctctaaataaaaagtattcacagagtacttacataccgcaaaataaattaggagcattattataatgaaaagaactacactctggttaagtattacattgctgattgctttactaacaatctatacagtctaccaaaatgggcttgactttagtttttctctaaccatatctaaaaatgcggcttcagcaaatggctcaatggcgtttttatttactttgctaactatttttagtggcataaaatatctaacgtgtagatttactaaataagcactcacagagtgcttacatacattaaaattaattggggatgagacatgaaaacacaactgataaatggttactggacagctacgagttttacagataaattaaacactgctttggctgaactagaagcggacgggcacgaaatcgttgaagtacaatataaaacgcccgtagtcttctattctgctatagtaatttacaaataatgtactcacagagtacgtatatacgtgccgaaccacgttaaaagtataattggggatgacatatgacaaaacaaccatttaaaatgatgaaaactataggtgcggttgccctgattgtaatggcattgctgaattatgccaactttcagtttaactatacaaaatacagcgctcttattgtgacattaatgatgctggctcttggatttcagagctacagtgagaagaaaaaattcaattcagatattgcttttgtcacgattgctggcctagcgacgttatatatttttttcgttaactagagcattaaagggaatgaaattatgaaacaaagggacgtaccttttcgataaatataaaaaagtggtgtaatttcaaacaagttagctgatgacattgacgagattcatatgctcatcattgctaactccgtcaacaaaatagaaaataaagaaagagaaaatgtaaatatggaaaacataaatatacacagcaaaatgtttcaatatagagcagcgctttttgtaattgctatttcttttattgtagccaattttacatatccgaataatatctatattcagcgctcaatgccattgttactagcatttatgcttatttcatacgctgttgagagatttagagagaaaaaatggttacctttttcagcttacgcattggttagcctgctcaatatttttcaggttagccaagaactatatcgccatttatatatttataaataataaccaaatctccaaatactagttgggggcttttcgctttataaaacaaaagtgatttaatggcatgcttttgactcgctaattcacagtgtcagcaaataaataataataagttaaaacacgctctctcattattttatatattaacttctaatccaactccgacctcttcaacagtaataaattgatttatatatgccttagctttaaaagaaacacagtgactcggatatagttgtgcaatattattattttgaaaataatcaacagttttttctaatcgttcatctaggtcaaacaaatgaaagccaccaatgataccaagtattttattggtacctgtaactttcttagcatgctcacaaatattgcaaatgccgctatgggaacatcctgtgataataaatagcccttcatctgtttcataaaccatcgctgtatcatccattacataatcgtcttcccatttattattaacaaaatattctcctatggcttctcgctcttcaaaagcagtatactgacctatttctcctaagtaccaaattttatttgttaatttaattggttccttttgtaagttcaaatcaaacttatttgatacccattccgtacttttgggagacccgatatctaatttctcatatcgctttgaattcaaaaaaagtggatgtgcataaactgacttaccaaaaagtcctgatgattttgataaaaaactcataccacgtgtatgatcattgtgtccgtgcgaaaaaacaattttagtcatttcacttagattaatacccttgatttttgcattctgcaaaaatatgtcgctgtaccccatatcaaaaagtattttttcatcttgatcttctattagcatagataaagcgggctcaccgaaataatattcatcaataaatgtgttattgtctaccaaaatgtttatcttcattgctctcttccaatcttttatctttaatactttactatacagactaaattattttttaaaagtgcaaatcagtaaatttaatatattgtaaaaatcagtgatattcttttactatcaatattgacaagttagttaaacatttatataataatgtttcaaattcaaaaattacctatataaatatttttaattttatctaaagattcccattctaaattgcctaataaaaatagttagtttattattaatctatagttttctagggttccgctataataataggtctggtccaagagaaaacatacaatgattacattgtacacacggacggataaaagcctaggagatatttcttaacgaaatatttcctaggctttttaatttactaaggagaatacactatggaattaatacttttgccagaacaactctcggtttttcaaatcgaatcattggaacaattggatttatcaatgaagcctctgtttattggctctactgcagatgagctttctatcgttgctccaacaaagagtgtgccaacaaaaacaataaaccaagaagatggttggcgcgcattaaaaatcaatggtgttttagatttcagtttagttggcattttatctaagatagcaactttgttaaccgaaattgacgtcagcatatttgcaatatcaacgtacatactgattatattttaataaaagaaacaaatctctctaattcaatagactgtctgcgtcaaaaccaatatgtagtttcagaaaaataagtaacgcaaaatagctcacaatcaaaaatcaataaagtactgcatttttacataaaaaaagcgttgcaccaagatcttggtgcaacgccatgaaatgctaaatggagaagaagggattcgaaccctcgcacgctttaacacgtctacacccttagcaagggcgcctcttcagccgcttgagtacttctccataacaataactaatataccagaatttagaacggatagcaatacccaaaatgccgtcaacactgctttttgcgctcaataaacagttcatgagcgaagactcatagtaatgtcataattaccgtatttcaatgccatggttttccatgaaagattgctttagttgcttttaaaaagccgacagacactcacatagagtccgtatcggcttttttaattacattcggtcaagtttaaccgtcgcatatctggaaacacctgctcatctattacacgggtgcacagaaattgttaactcttgattgttattccgcttcttctttatagcttaatgcggcaacgtttaattctttatctcctagtccctttgtaaagctagtttcgtgggaaacaataatcacgtttcctgggaatttgtcgatagctgcacgcaaagcattttttgtgccttcatccaagtggtttgtcggttcatctaaaatcaagaaattacttggtttcatttccataatggccaacttaactttggtctgttccccaccagaaagctgcttcattggtttttgcgcattttcagcgttaataccagcagcagctaaccgagtacgtaaagctttcggctccaatttagggaaacgatcttgcatttcttgcagtggtgttttttgatcattgtcccattctaaatcttgatcaaagtaattcacaactgctgatggtgaaaactctgcttcaccaccaagtgctggaataacacccaaaacagatttaattagtgtagacttaccagcaccgttgaaacctttgaagacaaccttttgacccgatgtcatcgaaaaggtcaccggctccaaaacaggtgttacataaccaacagaaagttcattcactgttagtgcgtttgcagactgagagttaacatagggaaaattaaacttagcttgcaatgcctctgacggtggatcaactcgatccattcttgccaacattttttcacgtgacttggcttgttttgatgttgacgcacgtgccttgtttttggcaatgaatttttgcgctttctcaatttcaccttgttgcttttcatattgacgtaactgttgctcagctcgctcgtctttttgacgcattgcctttttaaatgagccacggaacttagtaattttaccaaacgataggtcaattattgcattggttaccttatccaggaagtcaaaatcatgcgaaataatcatcgctgacccttcaaaagactgtaggaaatcttcaagccattcaatatgggccacatctagatagtttgttggttcatctaagataataacgtcgtcattttctaacaataacttagccagaatgactttggcacgttggccaccagacattgattctagtgcccgagtgcgcccaatggcttccaatcccaatccagaaatcacgcgctcaattttggtgtccacgtcataaaatccggcagcgtctagctcttcttgcatgcgtccggcgcgttctaacaatttgtcagataagctctctgcatattcattgtacagttccgtaatacggtcttgtttgtcatacaaatcttgataagccgtatgcaaaaaatcaaccagcgtcattccctcaggaatttctgcatactggtctagatagccgacctttaagcctttttgccattcgattttaccagagagaggtagttcttgaccggtaatgatcttgataagtgttgacttaccagcaccattttggccaacaatgcccatgtgttctccagcctgtaattcaaatgctgcatcttcgtataaagttttttctgcgtaggccattgaaaggcctgaaatttctaataatgccataactataagtctaccatactttaaagcaacattgagtatgtacgaggtattttttgcgtttcccccgataaaacagcgtctcgtgttttttcgataacttctttggaatatttcactttatctttttggtcagtaatttcgtaaacagtaagaaccgaatgagctaattgatagccttcttccacacttccttgcatcatcattaataaaccctttccaaatttcaaacgaattcgctcaccagtccaatctaatataaactggtcagcatcgctcaatatttgttccgataaggttaacatttcagctgcacctttaagatctacaaaaagcagtccattaaaggctgtataagcaatatctactaatcgctttttttctgtacgtaactgtgtataaaattttgctcgtttgatagctaaacggcttaaaattaacaggtcacttggagacataccaaaataaaacaaagtaaaaatatctaattcaatttgtccccacgtttcggcttgctttaaaaaattaactgctggtctgacgtgttttttcacaatatcaatgtcatatatttgtaaattctcttcttcggcaagtgcgccctgtatcattaaaccaaaatcacgtataaagcgtgcactgataccgccacgaccttgacgcatatcatttgtagctttcaaaatcattgctcctaattgtttcttttcttgtggtttcccggattgaacacccatttcacggagcaacatataaatataattattgttggtttctccaccaagaaacaagaattcatcatgactaacacccatatctgataataatttatctagccgatccgctgaaatacgagtatgccctttttcaaattttccaatcagtgatcgagatatgctaggctgttctaagtcaactatttttaaacccttatcttctcgtaaacgtttaaaagtcgcaccataattcattttcattaccctcattatttaaaaaatagaatatattctctttttgttgtcaaactgactttaccatgtatgctatatttattcaatttatcattaaaaaaaggagttcttatatgcgcgttgccaaaaataatacagcatttcgagtaatgattacatcacagttcgttaataacttaggaagcagctttttcaatattgtttttttagtttatgctgcaacactgccaaacaaaacacttagtgttacattagttgcatttacagaaatactaccaacactattctccattattgttggaaactttgctgataaaacgaagcatcaccttcggtcttggcgtattgctcgcctctctcaatcaataatttttttgattattactgtgatattgattttctttgacggtcaattttggagttttttgatactgttattattagtctttgtttcttcggtagtcggatcttatagtaatttactaatgaaaccagtttctagatttattttaagcgattctgatctgcaagaagcaatgagcttggagcaaactgtcagtgttgccgtcaacttaattggtggtttttccggcgtcgctttacttggcattttgcatcaaaattacgctggatttagtcttatcaatgctgggatgtttgttattgcttggtccattatggcgcttaatcatcgtcaatttttggaagccgaacaacatattgaagcagaaacaaagccaaataccaatacatcaattttttcagatttaaaatcaacttttatttatgtttacaaggatcatttgttttttcaaattttactactcgctaccgccattaattttgtcggcacctcttttaatggtgttttcaacctgaccttattacataacaaatcgttattaattggtaactttgggacgaccgtagctatttttggtgcaataagttcaattggcctattaactggatctttgattaccaatgattttttcaagaaactaacaacaaaacaattaattggcatttctggtattggtattgtgttaattgctgctgtaccccttttttatccaaatggtgttttatggatgctaatcatttttttattttcatacattgaagctaaaatcaatccaaaattaggggcaatcttaatgaaacgaatcgatcataatcgcttggctggtgtttctggtctaattaatacattcgttatgtcggccacgccacttggtcaaattatttttctcggcaccgcaaacatctattcaccaaatatttcttggttcttcatggtatttgtcgcatcactgattaccatttatacaatcttaactcgccaacaagatatggaactggttgaaaaaaccagagaatccgctatactataattattatgaaaccacgtaaactaaacatcaaaactattccagctgctgacatcaaccgtgcttatcgcttttggcgtgatgtatttgatttgccgcaatctggtcaccaaagtggtcggcaccttgtaattgatggcgaagatattgtgtttgtcaccggaaaaccaactgaccgcctagaaatgctcgttcgtgatcaccaagccgatttggtaaaacacttacgaaacaatttcatcccaattattggcgagccagaaaaaagattcggaaacaaaattgccttatcaatacatgattccgaggataatttaattgttttagaagccaatgcttaagatcaaaataaaaagcgtaaacagctattatagttgtttacgcttttttactattaaagtgttgtaaaatcaatgaccttacgaccagtaattgaaccagctttcatttcatcaataatttcattcatatcttggaaggcaactgtctcaacaattggcttaacttttccttcagcaccaaattggaaagcttcctttaggtctgcacgtgttccaactaatgaaccgcgaacttcaataccatcaaggactgttttagcaatattcaaagccatatcaccttgtggcaaagcaacggctacaagcttgcccattggacgaagtacattcacagcctgggagaatgcagcatcgttaacagctgtcacttgggcattgtgaacgccgccagttaattcattcaccttagccacaacatcttccttcttacgattaactagtacttccgctccattagcttttgcggctgctaatttatcatcgtttccatcaataactgcaacgtgagcaccgaaaacactgtgtgcatattgaacagccaaattacctagaccaccagcaccgtgaactgacacccactcaccaggcttagtttcaccgactttcaaggctttatacattgtaacaccagcacaagtaattgatgtcgcttcaacagggtctaaaccttctggtactttaaccgcatacttagcatttacaacaacttgttgtgacattgcgccatcaattgtgtaaccagaattacgcaccttacggcagaacgtttcgtttcctgagacacagtaatcacaaacgccacaagcgtcatagaaccaggcaattgaaacacggtcaccgactttaaggtaatcgctagcaccttcacctaatttagacacgcgtccaacaccttcatgtccaataactcgaccaaaattaccgttacgttcaccgatcttgttagggtcaccgaaatcgccgtttgcacagtgcaaatcagtgtgacaaaggccaacgtattcaacatcaaccaatgcatctccaaatgctaacgcacgtggctgccaatcctcgatcaaatcaacataaccatcatttacgttacgaacaactgctgctttcatttttaacctctttcttgtatgtgaacttatttacaattaattttaccgctttttgtcatatttgtaaagtattatttactacgcatctccttccattagtgactcgtttcacataaatacccaaaagaaaaagaacattatcattaaatgttccttttaattttattgaattattggtcagtatttaattttttaaatccaggaattgttaacataaaaattaaactaatgacgtacattaacgataaactcagcatcacggctgccacactataattgtccataatccaaccaatcacaactgatgaaaaggcaccaatagcacggccagatcccatcaaggtattggctgcagttgctcgaatttccgaaggatacaattgactaataactgcgccaaatccaccatacatgccgttagagaaaaatccaactaatgcacctaaaattgttaatgtccacatattatatgcaaatgtaaagacataaatcataagcgctgaagctactaagaatatagcaaacgcgcgtcggggacctatggtgtctagaatcgtaccaaaagtaagcataccaaccgccataccaataataataggtatcataccaagattgacgtatcctgctgtaattgtttctgtgatacccaattgcttccgcataattgttggcaaccagttcatcaaaccgtaatagcccgacgtttgaatagtcaacatcacaattaacacaaaagaagtataagcgcgtttgggggtattggcaatcgttttaaaactaaatttctttttaccagtcttgtagtcagcttgcagttgctcaaattcaggtgtttcttttaagtgtcgtctcacaatgtatacaacgattagtggcaaaaatcctaacatgaacaaaccacgccaaccaaaggaaggcataattaatgttgctaaaattgccgcgagtatggcacccacttgtccgccaattgcagtaatagagctcatacggcctacacgactagctctaaagctctcagcaatcaatgccatacttacaccatactcaccaccagttcccatccccagaaggaaacgagctgcataaatcgtgtgcgtgttatccaaaaatgccaagataactgtcgcaaaggtcacgagcataatagtataagacaatactttaacacgcccgatacggtcagctaaaataccaaacaagagacttcctaatagtgctccccagtttgacattgctgcaataattccaccctgtgcaccagtaatgtgtagctcggcaatcataggcgccaatgcgaaagataggaacgttgcgtccatatgatccaaagtaaaccctagggttgttgatccaagaaccaccttttgttcgctggtcatttgagcaccagtctctacctgatcttgctgcattacgttttcggactgactaattgtcatatattgttttcctccaaaatgtctgctcactggcaaacgttattttgtccgttaattattaaaccatatatacagtaattaatcaatcaaacgtttaacaatttttaaattattgtacaaaaaaagcgctctcgcgctatttttaaaattacttttctgaaattgaagcgattccaggcaattccttaccttcaaggtattcaagtgaagcaccaccaccagttgaaatgtgggtcaacttgtcggcaacacccaattgttgtaccgcagcagttgaatcaccaccaccaacgattgttgtaccaccattttcagtcactttaaccaattcttcaccaattgccaaagtaccctttgcaaaattagacatttcgaacacacccataggtccgttccaaacaacagtctttgcatcagacaatgtgtcttgcaacaacttaacagacttaggaccaatatctagacccatgtagccgtcagggataccagcttcagcatcaacaacttcagtctttgcatcatttgaaaatgcgtcagcagcaattgaatcaattggcaaaaccaacttgtcgccagcttctgccatcaattccttagccaattcaactttatcagcttcaaacaatgaattaccaatcttgttacccttagcagcatcgaatgtataggccattccaccaccaacgataaccttatcagccttgttcaataatgactttacgatttcaattttatcagaaacctttgcaccaccaataatagcaacgaaaggacgaactgggttcgcaacagcatcacccaagaacttgatttctttttccatcaagaagccagcagctgcttgtgaaacatttgaagcaatacctacgtttgaagcgtgggcacggtgagctgtaccaaaggcatcgttgatgaacaaatcatcacccaatgatgcccaatacttgcccaattcaggattgttctttgattcatttttgaccacttcgccatcaacaacgtcttcaaaacgtgtgttttcaaccatcaaaacttcaccatcttgcaaagcgttgattgctgattctaattcttcaccgcgagtttgtggcacgaacttaacgtccttacccaataattcacccaagcgtgcggcaactggtgctaatgacaattctttcttatcgtcttcagacttaatacgtcccaaatgagagaacaaaattgcgcgaccattgttttctaaaacatacttgattgttggcaaagctgccacaatacggttatcgtttccgataacgcctgccttgataggcacgttgaaatcaacgcgcatcaatactttcttacctgaaagttccaaatctgaaacagtcaatttagccatgatagcctccaaatttttatagttacaagtctattataaaacaaaattttgtctttgtgttgttcgcgtgtgagaaactgcacgattaatttcgacggtgaacctttttcataggcaatcccgtcatccgtaacttcaaataatttttttggtccaccaaaatccgtgttatttcatgttgattatcttttaaaataacggttaattgactccaaatatctcttttttcgtttgataattcgtcaagaattgttaacgttgttcgcttaggtacgtagctcatttctctttgcaactgcgtaacattataatcatttccagcatatttacttaacgtgttcatgatatatttttcagcactagcatatttttgaccagcaacataaacaaaattgcgtttaccttcaaaataataatcactgaccaccacttcaggatgaccaaaataaaaatcggattctaataactttccttcgctaaaatattgttttgcaaataaacgtccgtcccgtaaataaatatctttatagtctattttaccatctgaatcctgccaaacaactgcctgcacgattcgtttagaatcaccaaaccaacgtacagttgctagctgttgcccacgactaacgatacttttagtccagtctttgttaataatcaattgcgcctcgttgggcactggtaattcaccccaccagatgcctttggtttcatcaatctcacttaaataagactgcgcatatatatcaaacaccctatgaggatttagaccaagttttttaatgagatgcgctgcatcttcatgtggtgtagccaaccacaattcatcactattaccggactttacttgctctatttgccaagcaactccctttaaattggtttctgtgagggaattgataatctctatcttcatattagcacctcacatatcttttgccactgatcagcgatgttatttgtctgatattcctgtgcctttttgtgagcaccaacagataagtgatcataattatcgaaaatacgtcgcatcgcatcagcaagactggaaatattagcacactcttgcgctttgtctctgtcaaaatcagctagacacccattcactccctcacacacaagctcttgggcaccatataagttagcataggtggctatcggtaaagcgtccccaatggcttcaatatacgttaatccgaacccctcagaataagaggctgatacaaatgcatcatatttttgaaaatcatgaataatgtcttggctcaaaccttttaaatgcacactaaattgcaagtctaattccgctattgctctttgtatattttctttttcgtttcctgaaccgtagatggctaacgtgacatccatcccctcatcgcgtaattttttaatcgcttttatgatttgtagtatatttttttctggatgtaagcgtgaggcggtgacgaaattagctgtaccgccgtgccagcgacgtggattttctaatttagctaccccaccgaccggtactgcacaaattttatctgcgcctcgcatattcatttgagtaagttgtttttttatcatctcagcttgtaattctgtagctgttacgactaagtccatatcatccagatgatcaaacatatattgataataattgttccataaagggtgcccaccttgataggttactaggtgttcagcatgaatcatatccacaattttcaagggtaatccaatacgctttaatcgtactaatgattcttcacacgctgtcccacgatctaaaaaataaatatttttttgaaaaatatgttgcatttctataaaaaagaaatcaattaatgcttcttttgttaaaaaaacataatttttaccacgaaaattacgtagatgaatatttgtagcaatttttccacgtgaaccactatctcgatagtgccacattatttcatggataccattttttaaaataacacgatcatcgtcaatcaagaataattttttcgcttcagaataacttttagaacgaaaaatggtctcagtatattgccccgtcgtttgatgcacgatagtgcgctgcgtgttcgttaagtcccacagagagttagtggaatattcattaatttccgttaaaccagttttggcgtatcgatctggatcatcacttaacaacaaatcatataatccgataacttcattttctggtagggaccacaattgcatatgatggtgtaattgtggcaataagtcagtgaagataaacttaaattcaatctttttttcacgaaaacagtgcgcacgataaaactgtgcgtgttcaacgccactattactttctccaattgccttattcacaaaaaagttcataattatcgcctcacattttatctgttatggataattatatacaaaaaaaggaactctcccaagttcctttttatattagttgcccctgctggattcgaaccagcgcatgtcggtaccaaaaaccgatgccttaccacttggcgaaggggcaatagctaatttattttgccgttagcttttatcggcaatgggagcggtaggattcgaacctacgaacccgaaggaacggagttacagtccgtcgcgtttagccagacttcgctacactcccatatctcaaacaactatattataataccagaaaatcaggccgttgacaataccttttcataatttttttaaacattcttcttcatagaatcacgaaccaacccaaaaattgtccacagagctacaataacaattaacttgtttaataaatcgacattcatactagtaaagaacttagccgcaacaatcacacctagaacaccacctatagccactccagcaaaccctcgccatgatacccgattcattttgattacatttaaagctgtcgtaggcataatcaatgctgcatctaacatcattacagggaaagcaacagcgggattaacacccatcaaagagaagaatattaattctggcgcataattacccaaacccatagtcatcaatacaccaataccaaagttgaaaacaattcccaaaatcaaccaccagccatgtaacccatgcacacccattgaattattacttcctggggtagtaatcatacgtactaccatgataataacagcaattaataacgctacagccatcacacgttgtaccgtaggtgcgtgccatttttttgtgacatgggtcccgacgtaagccccaatcactgcagctgttgtcataggtaataacgttgtcaattcaactttaacagccgtaataaaaaataaagcttgaaacattactggtatcgcatgaaccgcgttcaaggttcccggtaatttgcgatcatcatctatataatgtgtcatccggaatgccgcggttgttgttgcaaatgaaccaatacccagtgtatctccaaaatctgttataaatccaatcaacatgcctaaaccaaatcgcttaaaaatgggttgtctatggagcagataagatctgataacaactataatcattgctatcatcacaacaacaagtagtatttgtatactatacagtatgaaattttcaggaaacatatttctctcacttcaaaattaatcttttttattgtatcaaaaaaaagcgcctattttgcgctttttaactgtaacatatatttaaaaataaattcaccaaatttgtacacgttcatggggatcaagccacatgttatctccttgcttcacgttaaatgtcgcaaagaagtcatcaaaatttttcacttgtatattgacccgtaatttagcaggaccgtgaggatctgatgcggctagtaacttcatatattctggtcgtgctttcattcgccaaatggcagcccaattttcaaagaattcagttgcagagaagtcatcatcacgtttagctgcttctagtgcggctgctaaaccacctaagtctgctacgttttcggaaacagttaggtgaccattgacttttgcaccgtatgagtctaaaccatcaaattgcgcaacaatttgttccgtccttactttgaatgactcatagtccttgtctgtccaccagttattcagactaccaaattcatcaaatgaagcaccattggtatcaaatgcatgagaaatttcatgagcaatcactgcgccaatgccaccataattggccgaagatgattgtgccaagctataaaatggttcttgtaaaatagccgccggaaaaacaatctgattttgctgtggatcataatacgcgttaaccaaatgagccggcatgtgccattcgctacgatcgactggttgatgccacttgctccaagcataagcaatttctatctttcgaaatttcaaagctgtttcaaacaacgttgcatcgctagaaactacttttttcttcaagcgttctggtaacttttctggatagccaatgtgtggcacaatggtatttaacttagtaactgccttcttgcgcgtttctgtgtttagccactgtaccgactgcaaccgattcttataaacatcaatcattgaagcaactttttcttcaacatcagctttggcttcaggagaaaatttctctgatgcataatataagccaattgcttggttaaacgggcgtgatgcaagataaaaggctgatttttcttgactcatcgcttcaggaagaccacttaatgctcgttgatagactcctcccaagatgcgaatttcgtccgatagatatggtgtaaattgattaaccaatgccacaagcaggtatgcttttaataatggccatgcttcttctgaataaaattgatcagccgcttgccaaaaacgttcttctggaaccacaaccatatccggtatctgaccaaccaattcatttaaaatatcgtttaagggtaacgccggtgataattggacaaacttttcccactcatatgggtggtatagctttgcatactcgtgcccctcttcttgactcaataccacggtcgcaacccgtgcatcaaatgcaagatatttgtcaatcaaatcattagtttcactttctgaaaagccaaattttggcaacaaatcctcttgttcttcacgaaacttagcaagtaacacctttgcctgtggatgatctttagcatagtatgttgtgtctggcaaaagaatatccagaccacccgcccacaaaacgttggtacgtgcgtccttgaaatcaggttccacaccaaacggaaacgcattcggtaatcccgttttttctaaatcagcgatgtgtgaagcaaagtcagcaaaagacgaaaaggattggtattgcttcaaaaatggtcgtattggagacgaaccaagctcgtcacgtgttgcaaaatcagatgccaatcgatgatatttcacaaagttattcaaaatatcgtcatcaggtaaatcttgacctttttgccagccagatgtcgtttttagtaaccactgctcaatatcatcggctaaatcactaaacccaccagtgcgaggtttatcagatggaattaccgcctttttttcccattctccatttattgcctcataaaaatcatcttggattcgaaccattaaatcactccttctcatttaatacactcaatttgttaacaaacattatatactagtttcattaaaatataaaaatcgaacaatattgcatgttcgatttttatattacttctgttgtactttataagttgcggcttcttcttcagttgccaaaacaaagtgccctggattaacttccaacattgtacgttctttgccgtctgtttcaacactagaatcgtaatcaatatgttggcgattattctcaacttccggatcaggtaccggaatagctgataatagacttttcgtgtatggatgcaaggggtgattatatacggcgtctgccgttccaatctcaagcagctttccccaatgcatgacaccaatacgatctgaaatatattttaccatcgacaaatcgtgagcgatgaacaagtaagttaatgaatgtttcttttgtaattctttcatcaaattaacaacctgcgcttgaatcgaaacatccaacgccgatatcggttcatcagcaataatgaacttaggatcgaccgcaagtgcacgcgcaattccaatacgctgacgctgtccaccggagaattcatgtggataacgagaagcatgatctttgtttaaaccaactaagtccaacaactcttggaccttagcattacgctcttctttggacttcgctaaatggttcacgtcgataccttcagcaatgatgtcacgtactttcatacgtccattcaaactagcttgaggatcttggaaaatcatttgtgaatccttacgaaattcagaaagatgctttccttttaacttagtgacatcttccccatcaaatgtaattgaaccagccgttggttcatataattttaaaattgtacgaccaattgttgttttaccagatccagattcaccaacaaggccaaatacttcaccttcataaatatcaaaactgacatggtcaatagcacgaacttcattcgatttacctttgttaaaatacaactgtaaatctttcaactcaaccaatttctttggtgtttcttcggtcatgattaagcctcctgcccttgtaattcttgccaatgggcccaacgattcaaaatttttcttggtggggtaaccttaggcgcacgttcatccaacaaccaagtggccgcatagtgtgtctcactaactttgaaaaatggtggttcctcacgactatcaattgctaatgcgtattgattacgtgccgcaaaggcatccccaacaggaggttccaacaaatcaggtggtgttcctggaatggcttgcagcgatccttcttcagtatctgttgttggcattgaattcaacaatccccatgtatatggatgttgtggattgaagaaaatttcatcaacagtgccatactcaacaattttaccagcatacataacagccactcgattggccatgccagcaacaacacctaaatcatgagtgatgaaaataatggatgaatttgattctttctgtagttctttcatcaagttcaaaatttgcgcttgaatggttacatctaaggcagttgttggttcatctgcgatcaatatttcaggatcagctgccaaagcaattgcaataaccgcacgttgtctcattccacctgaccattggtgtggatagtcattgatgtgttcttcggcatcaggaataccaacacctttcatcaattctagcgcacgagccagagcctctttttctttcatgccacgatgcttaaccaatggttcagcaatttgatgaccaattttcattgttggatccaaacttgtcattggatcctgaaaaatcatagcaatttcgttaccacgaacgtgttgccactcttcttctttcaactctaataagtttttgtccttaaatatcaatcgactattatcaggaatgatggcattcttagcatttagtcccattaaagtttttgttgttactgattttcctgatccagactcaccaacaattgctaatgtttcaccttcatttaaatcaaatgaaacatcacgaatcgcctgcacggtaccagcataagtattgaagttgacgtgtaaattttcaacttttaaaattggattactcattatacatgtacctcttaatcttcactcgcacgtgggtcgaaagcatcacgcagtccgtcacctaatagaatgaacgccaacgaaattaacaccaacataccggaaggaatcaaaacttgataaggatagaattgcaacatactttgtgcatcagaaatcagtgatcccaatgatgctgttggtggtttaacacccaagttaatcgctgataatattgcttcaaacataatggcacttggcactgtcatcataatttgaacaataattgtaccagccatatttggtatcaaatgtttgatagcaatttttgttgaactctcacccaatgattttgcggctaatatatagtcacgttctttcaaagaaagtgtcatattacgaacttgacgagccatactcaaccaaccagtaatggcaatcgcgattataatcgatgtaacaccattaccaagtaacaaaccaaacattgtaacaacaattaggtttggaacagatgagagaatttcaatgattcgttgcatgacaacatcgacccaaccgcctttccatccagaaatgacgccataggtcacaccaataactaaatcaatgactgttgccgagattgcaactaatagagaaatgcgcataccgacaataacacgttttcctagtgaacggccaatgttatcagtaccaaacaaaaagttttgcttcacattattatcactatatgaatcggtcgcttctgttgatcctggtgattttattttaccgttccagccaggaattggtagtccagactttggtggtaaatttttatatttaccgacattgtcagaatcaaacgagtttgcgtcactttgcttcacaaaaacattcgatataatggcaaatccaaggataaataccaaaaaccacattgatacaaccgctaatttatttaatttcagacgacgccaagcatcctgccaaaatgacagtgctggcttggaaatatgttcgttggcatcagagctttgtgcgccaacgatgacaaaatcttcagtatttgcagccatcatgagcctccttattgcaaacgaacacgtggatcaacaattgccgtcaaaatgtccgtaatcagaatcattaccatcaacatcacagcataaacaattgttgtacccatgataactggaaaatcttttgtaggaatagatgagacgaattgttgcccaatacctggaattgagaaaatattttcgatcagtgttgatccggttaacaaaccagcagccatcggtccaactaatgtcaaaactggaatcattgaattacgataagcatgtttattgacaatttctttttcactaagacctttagcacgtgccaactgtacatagtctgatcctaaagcctcaatcatttctgaacggacaaagcgcgtcacaacggcggccggtgtaacagctaatgctaaggttggcaaaacggactgagaaaatgaatccccccaaccagacactggaaatagcggccacttaaatccaaataaatataggaaaataattcctaaaataaaacttggaaccgaaattcctagtgttgataccacacctaatgtgccatcaattttattatttttatttcgagctgatactgcacccattagcagaccagcaacaacaccgataaccagtgcttgggcacccagctgggctgagattggtaaccgttgtccgattaacatgctgacactttgattttgatattggaaggatgttccaaaatcaccacgaaaggcatttactaaataattcaggtattgttgccataaaggcaaatccaatccgtatgctttgtttaattgggcaatcatttgcggcgttaatttaggattattgaacggtgttcctggcataacttgcatcaggaaaaacgtagcagtaatcaccaagaataacgtgaaaatcagaagcgccaatcgctttaaaatatatttcaccatagtcttgtcttcctaataaataagaattgacatacgtcaattctcattttgattaaatgtagtttaattctatcataaatttcttacttacggtaagcgtattttagatcgatatttagtcctgttgtgttaataattacacccttaacatttggacgagccaatgaatagcctgaacggaagtaaagtggattaaagttagcttgcttatacaaagctgattcagcttccttatagtccgcatcacgagcagaatcattcaaagcatttgtagtttctgctctgttaactgcctttgtgtacgcagcattcttgaactgaccgttgttatatgaagaaccatctttgaacagatcatagaaagttgagccttcaggataatcgccgccccaaagtgaaacaaccgcatcaaagttttgcgtttctgaatcagataaacgttgcttgaatggcacaaacttttcttcaaccttcaagcctggcaaagccttttgtaatgagccttgcaagtaatccaaagtagtttttgcactggcgctgtcagcatcagaagtaattgtcaatgtcatgcttgattcaccgacttctttcaaaccttcagcaaacaatttagccgcttctttagtgtcatacttgtaaccaggagcaacgtactttgccaaatcttcgccagaagccgtcttagctaatccttgaggtgctaaaccagttgctgcagttgataggccagaagttacttgttctactagttctttacggtttgttgccaagttcaaagcttgacgaatttttgtatttgctaggaacttatttttaccagtttgattatactcaatataggctgttgttgcttcaggagcctttaccttatctttattgttcttgttagcagcatataattctggtgttgaaattgacgcacggtcaagcttaccttgcttatataattgaacagctgtctctgtcttcttaacaacggaatagtcaatttcctttgtcttaacgctctttgcatcccaataattatcgtttttaacaagtttgaaattattattagttccattccaaccttcaaacttataaggaccagaatacagttgcttagctgaagttgtaccatattttttaccttgtttttcaacaaagctttgcttctgtggcataaagttagcaaaagtcagtaaatacttaaactgcggaattggtcgttctaatttaaatgtaatcacattccctttagaagttacacccaactcgctaacctttgtcttgcctgcaacaatatcatccgcgttcttaacaccggatgtcaagtaagcatattgcgaagctgttttagggttaacgatacgttgccatgaataaacgaaatctttagcagttagttttgatccatctgaccacttcaatccactgcgcaatgtagcagtataagtcaatccatctttcgataccttaactgacttagctaattctggaacagccttacccttagcattaacacggagcaggttagatccggtgttaccaataactgttcctgagtaagtatccgtattttttgaaatatctaaagtttgaatttctgtcggaaaagaaaacttgagtgtatcacttgatgatccgttcgaaccaccccagagaccggcagcacgcgttccagcgccagcaacaaccacaacggctgcaccgatcgcccattttttccatgtatccatgaagatatatcctcccgatatacttaatatgttgatgttttttagtttaccatgttaatttctcatttgcaactcatttatattagattttaatattttgttgcatttcgttaaaatgtcaggaatactaacaaaattatactattaataagtttttttgtgctaaaaaacacctcattcgtcacaaaatttttaatcattgcaacagcaaaactataacatgcttagaataaaaataaaaaaagcatcgttttcttacttcacaaaagaaatatattaaacgcttcacatttcgtgtgaaacccatttcttttaaagaaaaccatgcttttattaaaaattataagttgtacttaggctaagcgacgatcaaaccacttggcaattaacgataggccataattcaacaagaagtatactaacgtaattgcaatcagaaccggaatgatataagtagagttttgtgcataaataatctgaccacgataagtcatctcggctaagacaatacccatagcaagacttgtgtccttaaccaatgatatcaactgtgaaatgattggtggaatcattttcttatatgcttggggcaggacaatgtagatcattgtctggatatttgttagtccattagcacgtgcaccttcaaactgtccttcatcaattgattctagtccgccacgcacaatttcagcgagcatggaagattcaaaagtactcatcgcaacaacagttgcccaaaagataggtaaatgaatgcctagctttggtaaagcaaaataaacgaagaaaataattaatagtaacggtaaattacgaataatattattaattgtaccgacaaacttagaaaaatatgggatacgttcaaattgaacaattccaatgattgatccagcaataaaacttagaataaccgagataattgatacaccaactgtaatgcctaatccacccaacaaatattggacgttttgcggtgtaaaggcgtcaaaaattcctaatgtaaccatattgtcctccttatgctgcgtgctttagtttgcgttcgagattttgcatgtagtagctcaatggcagtgtaattaccaaatagaaaagtgccacaatgatatacgtgctaaaagtgtcaaacgtagtagctgcaaccatatttccttgatacatcaaatccaatccaccaacaaaggctagaattgatgaatttttaaccaaattaatgaattggtttccaagtgatggtagtgctattttaaaggcttggggcagtacaatgtaccgcatactttgattaaacgataatccattagcacgcgccccttccatttgtccattatcaacggaaaggataccggcacgaacagtttcagcaataaaagctgatgtatataatgataatgcgatggttccagctgcaaacccgttcattgggataaccttagcaacaactaggaagaaaaagaaggtgataatcaataatggaatgttacgaaatacttgcacatatacattaccaattttttgcgcccatttttgtggcaaaatttgtaaaatagcaaagaacgtgcccaaaatcatagaaatgattagcgcaataatacttgatagtaaagtatatccgaatccttgcaagaacgttgggaaattattttgtaataacgtcattatttcgcctccaattcatgccaatcaagtcctggcacatcgctgaaccacttcttaattaatttattataggtaccatttttcttaattgttgcaagcgctttgttcgtctctctaaccattggcccttgattattatcaaaagcaataccataaggtccgtgggtaaaagtaccgcccacaatttgataatcggggttttctgtagcaaatccatacaaaatcgcattatcagttgacattgcctgaccttggccggccttaagggcttgcatacctgtggcataatcctgaacagctagcaacttggcctttggtgcaaatttctttgtctcttcggcagccgtagtcccaacaacaacgatgattttatactttgaatcgttcatatctttaattgacttaatgcctgagtcttttttaaccagaattgattgtccggcatcaaaatattgattcgtaaagtcaataattttttcacgttcaggtgtgattgtcattgttgataccgtaccatcaatattagtattcttcaataattgtatttttgaagatgaagacactggtacaaattccgcagacattggaacaccggtttgctttgatatctgaactgttaacgctttagcaatatcaacgtcgaaccctttagaaacaccagtctttgtgtccattaaaccaaataatttggtgtcagatttcacaccccaaataattcgccctagtttttcaacacgttgtaatgtatcttgatgctcttcatttttcttagcagcagtagttgcccacaataaaccgaggacaataacagcagctaaaacgattgtggcaatgataccaaactgtctttttttagctttttccatagtaacagagcgttaatggcttttattttcaaatatttcatatcataagatactgaaacttccaaaaacgcgtttcctccaaatctaaattttatttgtgatcaacttggctcaagaactgttgagcacgtggttctctaggattattaaagaattcttcggttgtactatcttcaagaatttcaccgtcagccataaagataacacgatcagccacagccttagcaaaactcatttcatgggtaacaacaagcattgtcatagatgagtccttagcaatatcacgcataacgtccaacacatccccaaccatttcaggatccaaagctgatgttggttcatcgaacaacaaggctttaggttgcatcgctagtgaacgagcaatagctgcacgttgcttttgaccacctgataattcagacggcatattagctgccttatctgccaaaccaactttatccaacaaagccattgctgtagacttattttcgtcttcactacgcttcaaaactagacgtggtgcaagcatcacgttttccaatgttgatttattattgtacaaattaaagtgctgaaaaaccatgccaacgttttttcggatacgattgatatcggttttgggatcatgtaaatcaaatccattgaccagaagcttaccttcttgtatttcttctagtccattaattgcacgaatcaaagttgactttccagaccctgaaggaccgataagaacaacagtctcaccttcatcaatttttaaattaatgttcttcaaagcatgaaacttcccataatatttctcgacgtttttaaattcaatcattgacatgacttaattctcctttttctgagcgtgtacaccgcagtgcacacggtagcaaaaactagcctaacataaaatctaaaactagtctcttctaattaccattttacgcatacttagtctgtttagtcaaagctgtatgtgaggttttataacaagaagttatagccattcactttgatatttgacttataccgctatcccactttgtgcgccttgcaatcgataaaggtcataataccttccacgtgctgcaagcagttcatcatgggttccacgttcaacgacctctccttgatccagcaccaaaattaaattagcatctttaatagtagaaagtctgtgggcaattgcgatcgtggttcgatcttgacgcattttaaccagtgagttctgaatttttgcttctgtttccgtgtccacgttcgcagtagcttcatccaatattaatattttaggattagctacaattgtgcgtgcgaaactgatcagttgtttctcaccagcagaaaaactgcttcctccttcttgtactttagcttgatacccgccgtccaaattttctatgaaatcgtcggcacccacaaattcagctgctaatttaatttgttcatccgtaagactgtcattgtacatacgaatgttaaacgcaatatcgccatagaacatgaatgggtcctgtaacactagtcccattttgctgcgtaatttgtccatcgcaatatcacgaatatcctgaccatcaatcaaaatttcacctgattgaaaatcataaaaacgcattaatgtattaatggtagaactttttccagaaccagtatgtcctaccaaggcaaccgtatcacccgggtttgcagtaaatgttaaatcttttaggattggatgacgaccatcatagctaaaattaacatgcttaaattcaatttttccatcagtgatgtctcccttagcattcgggttttgcgccggagcataagtatcgttaccgaggatgccaaggatgcgatatcctgatactaaaccttcttggaaaggactgaacaaattcataatactttccaaggggccaaaaatattgtttaaataagtagtaaatgcataaatagcacctgctgagacaactgtttgtatggaaagttcaccaaaataccataaaactaaaaccgtcgcaccacctaacaacatgtcaatcataggttctaataacagtgcgtcagccttaatcattttaaaacgggcattaaagtactcaccattaattttgccgaattcttttttaaagcgatcctcttgataaaattcttgaatgatatcaattccggtgacactttcagcaattttagcattcaatgccgacaaacgttcgcgcatatggcgaaatagtcgtgatgaaaagcgttgataaatgataatactagccacaatgaatggtacaacaatcatcataaggagggttgcatgcacatcaattgtccacatgccaatataggcaccaatcatactcatcacagcaaaggtaagttgcataaagaatcgccaaaaatctgtcaacgatgccgtatcattattaacccttgttaccagtgaacccgcaggcatttcatcgaaaaatttcatacccaatgtgtgtaacttttgaaatacgcgtaatcgcatatcttctaaagcatattcaccagccacagtgaaatagtaggcattcaaagcatctgtcacagcttgcaacacgcgaataactgccacaaaaacagcaaaactaatcgtaattctcagcggaacactgcttgtttgatgcaaataagtcgtcatatagtaagcaatgactcgtggtgcagcagcttgtaatagcgcaaaagccgcgccaattacaagtgccacgataaacattgaccgaaacggttttgccattttaatcaacgtccaaataacatgtagttgttctctaacaggaatattttttgcccaaacagaattatttttttctgtcatcatcctccccctttccctctaagttttgttgaaacgttgttgctaattgttgttgctcatacatttgggcataccatccttgttgcgcaatcagttcttcatgtcgaccacgttcagcaatttcaccgtggtcaaagactacaatttcattagcattcatcacggaactaattctgtgagcaacaatgatcgttgttttctcttgccgggtagtttttaaagtatgcaatatttgtttttccgtccgtgcgtcgacggccgacaaagcatcatctaaaattaaaatttctggatcgataattaaggcacgagctatagccaatcgctgcttctgaccgcccgataaacttacaccatgttcgccaacttgtgtatcgtatccctccggaaagttcaggatatcttcatgtaaggccgccattttagcagcactttccacttcctcttgtgatttattgacatcagcaaaccggatattatctctcactgttgttgaaaacaaaaaattttcctgcgcaacatagccaatcgctctgtgatacacacttaatttataatctttaatgttttttccagcaaaactaatttgaccagtataaccatcaaactggcgcagcaacagcttgattaaggttgttttaccagcaccaacacgcccaacaataccgacagtttcgccagcacgaatattcaatgaaatatctttcaaaacttccgattgatcatctggatatttaaactgatcaatccgaatagcaacatcaccatgtgatatgctatcatatccctgctcatcttcaacaattgatgatttttcagataaaatttcttggacacgcatatatgaagcattaccacgttccaatacgttaaacaactgccctaaaccaaacatcggccatacaagtaaccctaaataagttgaaaatgagacaagctgcccgattgaaattgaatcattcaataccaacgacccaccataagtaatcatcacaacataactaattgtcatcaccagcgtagccattggtccaaacaaggagtcaatggcggctacctttttattgatttgaatcgtcttttgtatttcctcatcaaaagcatcaacatcttgtttttcttgccccaatgttttaatagctttaattccagctatcgattcttgagacttgtttgataatcgtgaaaaggcttcttgagatgatgtgaatgcacgtcgcattttaggtgataaataccaaaccccggccgccaataatggtaaaggtaaaacaccaatcaacgtcaaacgccaatcaaccacaagggtcattgaaataaccgtaaaaataataataacaatcgaatcaactagcatcagtacgccaccagatgccactctctgcactgctgacaaatcgttcgtcgcatgtgccattaaatctcccgtacgtcgacgctgataaaatgtagtatccattttcaaatagtgatcaaacaattgttgccgcaatgttttttctaatagtgccgaaccttgaaaaatatgtgtaatccacgtataacgaaatatgtacatcaacacagaaaaaagcaaaataccaccagcatagaaaaatagctgatgcatcgtcatttgtcgggatactatcacatcagtgaaacgaccgattaacgctggggacaccatttgtgatacttctgtcagaaacaaaaaagtgagccccaacatatatagtcgtttgtgctctttaaagaaccacattaatttgccaaaaatagtcataagattctcccagactgtataaatctccataattcattaaatctatctaaataatataccatatttaaaaagattttttatattttattcatataaaattaattaaaattaccatcgcactgctaacaaaccacacagtaccatatataatgtgctgttttggatttaagttcatcacgccagcaaattctctcaaaaacgctataccacggtacggaaactgcgtgtaccctcctcggccttgcgcattaactccttgttttttcgcgagtaaaacaccacgaaaaacatgatactcgcttgtataaaatgtgaatgaactgttagttaatttagcacaattcctcaaattttcatatgtatttctagaatattcttccaatattgtcttttcacagggaacatttagtctttttacagcaaagtctctcatagcttctgcctcagaaactaattcatctttcccttgaccacccgaaaaaatgatagttggatactctgacattttggttgcatctttaacagctgcctgaatacgattaccaacaattcgaccaacatattgtccatcaactaacccaccgcctaagacaacaatcggaccacggattggtcgtttaaccaccaatccatacaagatactactgctaataaactgtaaaaattgccaaagaacgtacagtgacaaccatgggataacaacgagaatgggttttaaagatattgaaaacccatcattcagaagccaaatgccaatatcagcactagcatacacaagcaacactagtgggaaaactaactgctgtaggctatgttgccatttacgccaactttgaaaactgtgataggccagtgtaatcaccaaaaacagacccgcaatattcccccatttaacgaacagcttagcttcattaattatatgaacaactgatatacttggaaactgaatcacctgcagaccaataaataaaaaaatcacaataatcaatacataaaatcccagtcgtaaacttgctgggttaatcctgatttgatgccaaagtagccaagaaaacatacttatagctaaagttaaaattgttagaattgctatcataaagctattgtaacacgttgcttttacacacagttgtgccaccgctttttgagatataaaaagagcgctgaacgctcttaaaaaaatttatgctgtgataaacttatttgctgcgtcttctgggactctgaccaagtctaagtcaacaagacgttctgcaatttgcactgtattccaagcagcacctttaagcaggttatctgagacaacccacatatggaaactatcatcattttccaaatcgggacgcacacggccgacgaatgtttcgcgttttccttcggcattaattggctgtgggtacaactgttcctttggattgtcttccaaaacaacacctggggcttcactcagaatcgcttgaatatcagcggctgtcgctcctgatccggcatccgtttcaaaataaacagtctcgccatgaccaataggaacaggtacccggaccgctgttgctgtcactttaactgctttagaatttttatcaccgaacataatttttttagtctcatgaatcatcttccattcttcatgagtgtaaccgtcttcttcaaaaacatctatttgtggcagtaaattataagctaggggataatgatgcttagcacttttaaccggcaaaatctcagcatgcatttctttaccagcattgtgggcatcagtttctgaaactagctcttgccatgcagattgtcccgcaccagaagcagcttgataagttgacacgataacacgtgtcaaaccatatttagctttaatgggcgctagagcaacaaccatttgaatcgttgaacagttagggttggcaataattccttggtgttgtttcaaatctgcttcattaacttcaggaacaattaacgggacatcatcattcattcgccattggcttgaattatcaacaaccacagcgccgcgtttcacagcttcgggtgcaaatcgtgctgaaactgaaccaccaccgctagccaaaactaaatcaaccccatcaaaactttctggagttgcttcctcaacaaccacgtctgtacctttaaattgaagtgtcttacctgctgaacgtgacgaagcaagcaattttatattcttcacgggaatcgttgattgctctaattgttcaataagtcgtgtgcccacagcacctgttgcgccaagaatggcaacactatattctctagtcattatcttctcctaatctactaaaatacgatgtattctatcttgtagtcctgttgtgatttcccagggcgccaaacctgcaaactgtgcaacgtcctcgattgtattctctaagtctccatcttgaccaataaaggttaccgttgtaccttctggatattcacgaggcaaacgtatcattaactgatccattgctacttgccctacaataggggcgtattgaccgtcaataataaccttaaatcccattaatttgcgtagccaaccatccccataaccaataggaacagtgcctatccactcgttttgagttgtcgtatatttgtgtgaataactaataccttcaccagcaggtaagcgtttaacaaaatttacctcgctccgaagggccatgacgggtttcaggttacgtccatctgctagttcaccacgagagggctcaatcccataaagcaccgttcctacgcggacaacctcatggggaacctcttctgcgtgatacattgcagcacccgaattagcaacatgataatactttggttttggcaagtcatccgtcaattgatgccaacgtgttaattgcttttggaagtacctggtatctgatgaatcagattcggcaaagtgcgtcgatagtccaacatattcaaacttattagcatgatccaaaacaaactgtatcgctttcgctaaagtttcacgatctctaaacccaattctacccatgccagtatcgatacctagtgtaacaggtaatcgctgttcaccagttaactgatgttctgctttctccagccagtccaatgaaacaacagttgccatgatatgctggacagccattagttcaacatactttacctgtgaaatacctaaaattaaaattggtgcggttatgcgctcatgccgcagtgcaatagcttcatcaagaacagctacacctaagccataaatacctcctgccacagcagcttgagccataggaatcaaaccaaatccataggcatttgacttaacggtcaaaaagactttgtctgcacctgatacatttttaacggtcgttatattatgttcaacagcgctcttggaaacttcaagacgtgttggacgtgttattgcctctaccatatgttagcccattcacagatattctatgaatgcatacctcctctattaaaaaatccacagcgcacaagtagcagccatggatcccaattaattgcaatctataacatagcaccccgcttacgcgacagtccaacgatttttcaccgattggcccagctacttggtgtcacagcaccaatgcttcggctacatcccctttaacctgtttcattgtgcctgtaagcactccgcaagcgactaatgtcagcagcaacctctatgattcttaaattgttattattgtattctaattttttttatttgtcaaattcaatatttttacgcttgtttgattgataacactgtcaaatcaccgtataatgaatttaataacttatgaaatgatgggaactatgacgcgacttgttacagctacagaaatgcagcaaatagataattacacgattgagactattggtatgccacaggatgtattaattgaacgggccgcaatggcagtgcttgatgttatcggcgccggtagattcgatttgagtcatgtgttagtactagctggtcttggtaataatggtgctgacggcgtagcaatcgctcgtctcttgtacgctcaaggcgtaaatgtctcattacaatttgtcggaaacgttagccgtgcgaaagacagtgtgaaacggcaactggcaatcattgaaaagcatggcttagttcgttctgaaaaaagtgactttaatgaggcaactttaattattgatgcgatatttggagttggattgaacaacgttctacctgaaggcttacaaaaaatgattaaagcggccaaccacattgataaacctgtcattgctgttgatgttcctactggtattgatgcaacaacgggagaggtacgtggcgctgctcttaaagctcatactacagtcactttcggcttcacaaaggttggtttaacgcaacagaatggttgttacctttccggaaatgttattttaaaagatgtcgggatgcttattccagatgattttgaattcagtttacaggagacgctacctgttgcatagaatataatacttcacaatataaaaacagtttattaatgccaacctggcattaataaactgtttttttagtcaatatgtgtcacttcatcgccaatcaacaatttcttctccttctttagcaaacaataacaaatcagcaattgatgtacgttttaaccgtttcttaaaatctttttctgcttcatagacaatagatagaacttcttttgttccttcagcgacagcagttttggcaggaaacacgcgatctgccaattgggtagaatgaataaagctatcttctccttcaatcgcctcataaacatccaataacgtaatatcattggtattacgagccaatttgaaaccaccttccttactagcgatcgcttttattaaatttgcaacaactaatttgcgcattgttttttttaagtacgattcagatacttctaaatgttcacttaaaacatgacttttaacaggtaagccatctttttgcaaagctaacataaccaagacaaccaaactttgttcaactgcactagacattttcatttatttttccaacttcatttctttatgtacgcagtctgccgactgcttttaaattaatgcttaaaagttaactgattatggtttaatttcatttggtacacaaaccatgttagtaccattgatatcactcctaaggataacaatacagttaagtctgatgcaacactgccacccatagaaattgtttcgcggaaggcatggacagagtaactcattggcatccatggatgaattgcctcaaaaaaactgtttgacaactcaataggataagatcctgcactagcactcagttgtaataccatcaaaaccagcataatccctgaccctagtttaccaattagcacgttaaacaagacaacaaactgattgaacccaaaggatgctgctaaggctacaacaaatgtcatcgctggccgctgcgcttccatgccatccactaagaagagtaatccagtcataatcagtgcttgtccaataaaaactggcgcattaattaactgcttattagcccaccatgtgaaaccattttttggctttttagaaaccgtcatgaaatcaaatatggtcgtaaatgtgatcataccaacaaatagcccaacagacatcatatatggcgccattccggttccattgttaggaacctttgataaattagatgatttttgcttgactggctgtgataatgctaccacatttgatttcttattgtgtatggctgacaatttcacagcaccatcagctaatttattcgctaaagtggttgcaccagtacctgcctgctgtaaggcctcactagcttgattttcaccagtaagtaactgtgtcgtgccatcatttaattgcgaaacactactattaagtgtatcgttttgggcggctaactgtccaagtcctgtagttaattgagatgatccttgcgctagctgctgagcacctggtactgcttggttagctattccttgactgacagtagttaagctatcatttagtgttttaatggctgtttgcgcgccttgagtggcaatggatccttgttgaccgagtttctgtaattctggaatttctgcctgcaacgcttgtaattgtggcaacatagcttttaatgtagttaattgattttgaattgtagtggctgctgttgcacttgattgcacattttcagccaaatcacttaatgctgcttgatatttagcagcaacagtaggattttcttgtaaaaatttttggaaatcagcatcttgagctaatgctttgaaagcagctgcgtctttcccagcaccagttaatccagctgacagcttttcggacgcttcgttaagctttgttaaatcaacagttaccgttggtgattcaaccttacttagtttttgcaagccctgtgtcagttgcgtcaagcctgtatcaagctgctttaaatcagccgccttagcactttgctttgtattaatctcgtcagaaaccttttggagctgtgtggcaagttgttgagcacctgaagttaactgctgagcaccagtattagcggacgacacgccatttgtatactgtgacaagcccgttgccaactgtgaagtaccagtttggagctgcgttgtgccatcttgcaattttttagtaccatcttgtaattgtgataaaccactcccaagttgtgtagcacctttagatcccgattgaaaacctttttttgaggaggctgttgcatttaaaattgttttattataaacaccttgcagtgattttgagacatttgcctgtactttatcagccgcggaagccgttaatttttcagcaatgaatccttgccctgtattatgcgcaattttaatctcaggcttgactggcttagcatccaacagcgtacctgaattcttagtaaaggacttcggtatcgtgatggtcatgtaatactttccagatgcaagtccttttttagctttttcagccgaagtcttagttaattttaattgcttgctgtcaagcaattttttagttaaatcatcgcctatattctgtgactttccattaatctttgcggtcttatcttgattaacaatcgcaactggaagatggtccactctaccataagtatcccaaagtgacgacaaaaaaatgactgcgtataaactcggaatgagtgtaataccaaccaataataatggtaaccccctgatttttcgaacacggttccattctgaattctcaaaaaacttcctcatacttcgcactctttcgtgtatattttttatctatggatatattatagacacggaaagatgaaaatgcaacaatagttttcatttttttacatgttacttatgatacggtgatccttgttgaatcataaaagcacgataaatttgttcaatcagtacaagacgcattaattgatgtggcaaggtcagcaacccaaagctcatctttaggttcgccctttgcttgattgccttagataatccaagagaaccaccaataataaaagtaatgtccgaataaccattaaccgcaatggcttcaagtttttgagaaaattcctcggaaggaaactgtttcccttctattgctagcacaataacataatcacgcgaaccaattttcgcttgaattcgctccccttctctagccataatttgattattctgtgcttcactagcattttccggcgtcttttcatcaatcaactcaactacttgaactttacaaaagcgagataatcgttttgtatactccgcaatgccttctgttaaatacttttcctttagtttcccgaccgtgattaatttaatattcatttcaaacctactctttacaatttcttaatatttttggttgattacctatattcattatatccgatgttatccacacgaacaaaaaaaatatttttttctgaaaaagcttttataccaactcttttcgctgttcgctttttaagttatccactgttttttttaatttcaaaaaaaatgtggataactttataaacgttattttactcttatttagacaaattatagatattttcccgcaagttatccatagttatccacaaagttgtacacaattgtggataagcacacgcgttcgactaatgtttaaagtaaattttctttacattgttcggaaaatatattttaaataacattgcatcagtgttatttctttaatcgcttcaatacacgaacattgctgataggcgtctaaaaactgcccattttccctaaatattgcctaaaattaccaatatttattatttcttataaaaacaaagcacttatccacgaatttaaacgtcttttccacattttctggtatttagtccacaaattgtcaacattttcagcttgttttcaacatttacagaaaatacatattttttaataaaagtcaaacaagggtaaagaaaaagctaacatttttgttagcttgccaatttctgtgttaatttaaccttgacggtttgcttagtatcctgatgataataagtcaatgttattgtgtccccaagcgaatgcttgtagagttcttctcgcagatcagcctgtgagctgacctttttaccattaatgccaacaataacgtcgtacttcttcaatccagctttatctgctgggccattgttagtcaaactcattacaacaacaccaccagtaacgctatctggaattttcagtgttgatttttgctcagaagctgttacttctgacaaattaatcaaactaatgccaattgctggtcgtgtgactttaccatctttgactaatttgttaacaatgtcaacgacttgatcagaaggaattgcaaaacccatcccctcaacgctcgttccagaagaagatgttgataacttcattgagttaataccaataacttgtcctgcaaagttgattaatggtccacctgagttaccaggattaatagcagcatccgtctgaataaccgtggatccaccataattttgaccattttcagatgttgcctcaactaaccttttcttggccgaaatgatgccttgcgtcactgacgaagcatactcagatcccagcggcgaaccaattgccaagacattttcaccaacagttattttacttgaatcgccaaattgtgcagttgttgtaacgtctgtgccgtcgattttcagaacagctaagtcagtcatcgcatctttgccgactaatgtagcggtcactttcttcccactgtgcagcataacttgaattttagccgctccagtgattacgtgattattcgttacaataaatgccgatccatccgtttttttatagatcacgccagaaccttctgacgattcttgataactaccttgactggatttagtaaagttcaatacagatacaactgcatctgataccttattataagctgatgtagcagttgcattcttggcaatcgtttttgtacttgttgctgtcgtactcactttttgattttgattttgtaacaattgtacaccctgctgcccatacaaaattgctcctccaccaacaacaccagcaatgacgccagttaacaacgtttttgttaatgctgattgtaccattagtcacctctcgactatatttattttattttatcaatttgaagttaagcaaaaattaaattattctgataaattgtcgctcgtaaaggcattgattttcaaaatccctgtgctgccatttgcgtgtgttacaacaaatacccataccggtaaataaatgtcatagccattaacctttaccgatgtatcatatgatagagcgccttttgataatttatcaccactatttagctcattgaatttatagagagcgacaattgcggcttcctctgtaattgttgcacgttcatcgcgcaatactgtaaccttagttattttagtttgtgtaaaatcagttaccttacggtctttatctttgttaaagatcatcagcccttgtttagcgatgaccggcaaattatcaatatactgagaataggttacacgatttttcacattaactttagacagaataggattatatcgatatcctgcattacgtgctatctttgacgcctcaacatcatccgccgcagctttcttaccactactgctactactagtattccctctacctagttgcgatgttttattgaaagtcacgtagagcgtctgattattaatatttgcattgaagtttgacaacttatcaatcgttgacattaaactatttgatcgtttaccagctaaataactagcataagtaaccgaagtactaaagttagctacttttattttttgatttttaatctcactaatgatattcgcattggcgtcggttactttaatacttggtctctgattactacgccaccaaaaaaagagaaacacgtccaaaaagatgaataacatcgtcattaatatttttagtcgtctaaattgcataaaaacgtatttctcctttcatagttttcagaaccctgaatcatcctaattggaaactattctcgattagctagaaacgtattgacgctcatccaacccgttggcgtttcaatcatccatgtaggattcatgttgactgaaacgtcattttctttgttagccaaccattcatagcctggtgcaatagaataatactcactacttttgacaccagcttgttgtaacttagccaaaacatctgctgcttttggtaaagtaacatcttcttgcgtattaggaaccggcacacccaactcatttagcgaataggtgcttgttaggttaccgtatttatctaacgtcatatgaatagcaccagtttttgattggtaataaactggtagcccttcaacaaacgttcgataagtaatatccttcccattatcacggctctggtaaaagcgcgtatcagagagatctaactgtaacaaattaatttgcgaaaaaccgacattcaaccgattgtaatagctgcgctgtaatgtaccagtcgttcgattatctgtaaaggtcactgtttctaaatctggatcataaatgatttgttgattactgtatttattagtataaatttttttattgttctcagtggtctgggttaactgatttgtagtccctaagagtgctgatacataagtcgttggatcacgatgattcactaaataagagtacacaggtaatttaaactcttttgggtagttcaacatcacatgtccgttaaccactttaaagtttaccgttaaagctttgggcaaccgagcagcgaccttccatgcctcagttgtatcaattttgctaatagtaactgtcgtaatcgttttagactgtgtattcacaaaatatgcttttttagaatggttaagtggcacaacaacatagttaaagttaaaacttttatgcgttgatacacgctgagaataataagaattaaaatattcaattggcacaacgtctggatagtgatacaaggcagtttgcgttttatccagtaattgactaatctgcttattagttgcttttctttgcgtaggattcgtcattctagaatttgctaaatactgatgaatacttttatattgcgcattcgtggtgtgcataaccatatgctgtttgccacttttatcattcacaatgtagttcgtaggtctaaacaactcggaagcttgttgcgattgttgatccgtttgtgttggcgcctcttgactgcctgctgaaatgaatattaatgcagttagtacaatagaaacaataatagcaatcgtcaataaaatatttatcataacgccttggactgatcgattattctgcatcccaatcgtcctccggttcttcgtcaacataagctaacgaaatatagaaggtagagcccttattttcaactgaatcaacccaaatacgaccattaaacttttcaactacttccttagaaatagccaatcctagccctgttccaccctgcgcacgggaccttgatttatcaactcggaagaaacgattaaatatattatccaagtcttttcttggaatgcctagcccttgatcagagatgcttaagattgcacgtgtttttgtcttaatcagtcgggctgttatggtgccgccgtctggtgaatatttcaccgcattattcatgatattgtctaatacctgagtaaacttgtccggatcaacttcaacccaaacatcttccttggtaaattcacgcaaaatattatagtttttagtgattgtgttttcgtttttagcgtcactttccaaaatcatatcaaaacgattcaaaacaaagttaaacaaactgtttaaattaataacttctagcttgacctccatcgtgccttgatctagacgcgataactccaacaaatcattaatcattcgaatcatacgctgtgtttcatcttgaacaacacccaaaaagttttgtgccatttctgggtcatcaatagcgccttctgccaaagcatccacataggatcgaactgaagtcaaaggtgttcttaattcgtgcgatacattggaaacaaacatacgccgttcagaatctatacgttgttgctcggtaatatcatgtaggaccacaactaatccagaaataaaaccagattggcgtttaatcaaagaaacataggtctggactaacagttctttactatcatctgataagtctactctaaaatcatttagattttccaatatatcacgtaatgtacgtttgccctccaaacgtaagagactaacaacattttgtccaagggcatcttcccggttaacccctacaaaatctgctgcagcctgattaataatggtgacttcaccacgacgattagccgctaaaacaccatccgccatatgtgtcaaaaccgaatccaaacgattacgctccgcattgactgtttctgttgactcttcgatacgcgtagatagatcattaaccgataatgccaattgacttaactcatcagaaccataaatgtgattcaccatcgagtaatcaccttcagcgattttagtcgtctgttcactgatttgttcaattggtcttgtcaaggttcttgctaaaaatagggccagcgccacactggcaactagtgcaatcaagccagcaataataaacagtcgcatgacactgttaatattcttatatactggcaataaactggcttttacaacaataacaccggagacgtcttttaatctccccgtagacacccctagaggtgtcgtcatgatttctttacgctcgccgttttcattgatcgttcgagtggcaacatacgactggtccccagcaagcgccttttgtgcattaatgtcggtcgttttttggctgatcgtttgctgacctgatacagaagtcgttcctcgaattgttccagttttatcaataacttgtacttcttcaatgttggtattgtttaatcctgacaaaacgtcttggatttcatgattgccttcatcagagttactattacgtaaagcagtgttaattggatcagtaacatatttaggtaaggtgatctgttgttggaatgttcttaagttctgacgttccatttggcgtacgaaaaaagcacccaaaagttcgagtgcgataatcattagcagcacaaaaacaagtgtgatgcgaaaacgaatagattggaaaaatttagtaattgacgtcatcttcattatgctcaatggcgagcattcttcccctcattatgtacgcgtaaacttaaatttcattcatttattcttctgatgggcgtaaataatatccgacgccacggcgtgttgctagccaattaggatggctaggattgtcttcaattttctcacgtaatcgtcgaaccgtaacatctactgtacgtacgtcaccaaaataatcatagccccaaacttgctgtaacaagtgttcacgtgtcatcacctgtccaatatgttgtgctaaataatataataattcaaattcacgatgcgttaactcaatatcagcaccatcctttgaaaccatataggcttggggatggattactaaatcacctaagtgaatatcttctgtactattaaaagtctcttcagaagtttgcgaaacagactttcgacttcgcaaattagccttaactcgtgcaaccaattcacgattagaaaatggtttagtgacataatcatcggctcccatttctaaaccaagaaccttatcaatctcactatccttagcggtcaccatgatgacaggcacatctgacttagaacggatttgacgcaaaacctcgataccatctacttctggtaacatctgatctagtaaaaccaaatcaggattttcatcattatacatatctaatgcttcttgcccatccgcagcggtgactacatcgtagccttctttggttaggttaaatttaataatatcagaaatcggtttttcatcgtccacaactaatactttactcatggcagaactcctatcgtatatgtgtcgtttcttttcattataacatttcgggtaaacgaaaagaacaagcaatgtcacttgttctcataaaaatgcaacaatattttattaatgtccacgtcggtagaagcgatttttaaacaaagaactaatcgcctcatttttgctaatacgggtaattgcctcaccaatcagctctccaacagaaacaatttctaatttctcaaatttcttatcttctggtaaattgattgaatcagttagaataacttttttaaacactgaattctgtagacgttcaatggctggcccggagaaaacagcatgcgatgctactacataaacctctttggcaccgtgttccataacaagttgagcaccttgcgttatcgttccagcagtgtcaatcatatcatcaatcatgatagccgttttaccttcaacatcaccaacaatgctaccaacttcagccacgtttggttttggacggcgcttatcaatcactgcaactggtgactcaagttccaacatattattcaaattacgcgcgcgtgtcatcccaccgtggtcaggggaaacaacaaccgcattttttttatcagcaatgcctgattcaatcaaataatctgctaataatggggcgccttgtaggtgatccattggaatatcaaagaaaccttgaatttgagcggcatgaaggtctaatgctaatacacgtgtagctccggcacgttctaacatattagctaccaacttagctgtgattggctcacgagaacgcgctttgcgatcttgacgtgcgtagccataatacggcagaacaacattgatttgatttgcacttgcacgacgcaatgcatcaatcataatcaatagctccatcaaattatcattcacgggtgctgaagtcgattgaataacaaaaacattatcgccacgaatactttcctcaatgttaatttgcacttcaccatcagcaaagcgtttaacggaaatacggctcaacggaacaccaaccgaatcggcaatcttttgcgcaagtggttcgtttgagctgagtgaaaaaagtttcaatttaggttctggcatgtctaactccgagtttttataggtagctattgtagtattactgtattcattttaccaaaaaaaacatttaaatacaggtcttattacaagttttaaataagatattatgctatgacatttgataatgctgtcaaagctgcatcataatcaggttcatcagaaatttctggtacaatttgcgaataaaggaccacgcctgccgcatcgataatgtaaatcgatcgtgtgtcaaaaccagtgtctggtacatataacttagttgcgtatccaaatgattcttgctcatctgaaagcatacgcatgttatgtaccccttcagctgcgcaccaatcacgttgctctgctactgtatttgtggagatagtcacaaaattaacatctgtatattgatccacagcttggttaaatcgacgtgtctgtaatgagcaaatatctgtatttaaatccggaacgacagaaagcaacgtcacttttcctaacaaatcggccgtcttaactttttcattgttttgatcaactaatttgaaatgaggcacctcatcaccaactttaaggggatcgccttccaatgcaactttattaccatttaacagaacgttcatcttttttgcctccttggcttatatatcggaatattttaaattaagtaatctacacagattataacttcagctgtgtcaaaactaaaatacaactatcttttaaagaacatattcttctaggacccgcgctacaccggaatcattgtttgttgctgtctcgatgtcagctattgttttaattttttcaattgcattacccatggcaacacctaatcctgcgcgctcaatcattgaataatcattttcttgatcaccaattgccattgtgtttttaatatcaacatttaatgcttttgccagagcttcaagtgcattgcctttcgaagcatctttgttgataaactctaggttattggcagttgaccgaatcactgacattttgtcagaaatacttgttggcacattcgcttgtacgttatccaaatcgtcagattcagcgttggcaatgcccttaataatttcaacatgctccagctcattgtcattattaacaatatgtaacggcaaatttacaagagaattttcaaaactagcccaacgatgaattaaacgattggtcgtataagccgcgaactgatcctcagcttgaatatacgtcttttgctcacgcataaaggtatttagctctttatactctgccaaatctagtgcagcatgaaacaaaatttgagagccatcagcagtttgcattaagccaccattatgtgtaatgacatactgttcgctgcctacaatgcctaactcgtctaatatattgcgaacaccaggaagtggtcgaccggttgtaataacaactttgacatcttgtgcaagtgcctgttgaactgcagattttacatctaacggaatttgacgctcatcgttaatcaatgtgccgtcaatatcgatagacacaatttttatctctgacatgttttgactccatttttagggatactattattataccaaacagcagcgcattcaaaacattaatttgtatattattaattgcattataaacaacaaaaaattggtgattagacaccaattttttgcaaattatcataatgtttaaaacattcttttaaaataagcttagctgtgccttccccagctgtcatcatcaaattcttatcatctacattgatttgtggtaactgatatagcatttgcccgctattatttttcatagataccggcactgtttcaggtagacccgtaattttttggctttcttcatttaaaatctggtcaacccatttaggagcaacaacaacatctaagctagttggttgctgaataatagttgatatcacacatgataatgatacgtagtttacaacaacatcgggatatattttagcaattttttcagcagttagtgcccatatttttgatgtataaaacgaatcaaaaggggtgacgattgtgaccgccctttttcgattcatcgctcgctcaaaccccgccgtgataacttgttcaacttcacgttgttcatacgttattgtgtcttgtgcgaaatcatcgaccgaaatattaccatccacgtgatcattagccctcttagcactttgtacaattataaaatccgtatccctgactatttgattcttgagtggtgaggcatcaacattattatcagaaatttgaactgctttgcaagcaagtgtgatgtttaaatattttctcaatgccacaagcgattcttgtacgcttagtaaactatccgtccccacctcttggttcagtgcgccaaccaaaatgccatcataattcttcaattcgcgaagcgtctggtttggtaacggttcatgaaatgaaagtactgcgttgacaccaaaaggaagttccgtcacctcgaatgcagttgaatcatttacagatgacttaatgatgcccaaggctctgtcaattacactgctagattctttatcgccttttaatattgctaatttatacatcataatttttccttcttattctcatcttttcgtttttttattctacaaacattgcataatatagatttttagattaaaatatcaaccaggaggacactatccatgtcaaagaaagtcgtttcaacaactacagcgcccaaagcactcggaccctattcgcaagctattctaaatgacaatacattgtacatttctggacaaattggtattgatccagaaaccgacgaatttgctggcgctacgacagccgaacaagcacatcaaatttttgataacattgataacatcttacacgaagctgaattttcacgaaatgatatcgtaaaagctgcattattttttgatgatattgcagactttgcattagttaatgatatctacgcacaatacttcgatacaacttcggttgaggaatttcctgcccgttcagccgttcaggtagctgctttacctaaaaatgctaaattagaaattgaaattaccgctatgaaataaaaacttgatttaataaatcaagtttttttcttttcctaaactaacatattgaaaagcacagtattctcttgcaaattgatatatttcggaaaaaaagctgctaaacgggctgttaagtcatctactttcgtaacaggatccagcagaataccaaccatgacagagcctgtttcagagtttatttttttagtatattcaaaacgagtaatatcgtcgtttggtcctaaaacatcatttacaaattgccgtaatgccccgggtcgttgcggaaactcaactaagtaaaactgttggcgacccttatacattaatgccttttgttccatttcttgcatacggccgatatcattgtttccaccagaaacaactagaacgacgtttttccctacgatatcactggccataaaatccaaactagcgataggcatcgctccagctggttcggcaactatcgcctcataagtgtacaagtctaatactgcttgagcaacctttccttcagggatagccagcagtttgtcaacatactgctgtgcttgattataggtaaactgactgacacgcgcaacggcagcaccatcaacaaagtgatcaatattctcgacggtggtaggtttttgagcttgaaaagccgctttcattgactgtgccgtttctggttcgacacctactactgtggtttgtggtgatacctttttagaataggtcgacagaccaccgattaaaccgccaccaccaacagaagcaatcaaataatcaacattaatattttgctctacagcatcttcaaatacctcaaccgccaccgttccttgcccagccatggtacgccgatcatcaaatggtgctacaaagaacatattatgtttttcagtgtattcaaacgctgcactttgtgcttcgtcaaaggtatcaccgactaggattaccgtaacatattgactaccaaaacgtttaaccgcttctactttttgatttggtgtagtgactggcataaaaatagttgcttgtatctttaaattatgacatgtatcggctacgccttgcgcgtggtttccagctgaagcagcaacaaccccattattgagtttttctttctctgccttaatgatattgtagtaggcaccacgaattttgaacgaacgaacccgttgcatatcttctcgtttaagatacacattagctctatatttttttgatagatagtcatcatatgccaatggcgtatgcgttactacctttgacaagactcgatgcgcctcatctatttcttcagtcgttagctttccctcagtcgtcatgtattcatctccaattactaattcattttatgtacgaaaagcacgccatttcggtcaatgcttctcattttgttactttgctgctgagaattgctcagtatctgctgctgtcgagtacttatctgcatctgaaatccatggcatcatagcacgaaccttcttacctgtttgctcgtacaaaccgctcttatactctgtccgcatcttttccaaatccttcaaaccagaattgtattctgccaaccacttcttagcataagtaccatcttggatatctttcaaaacatcacgcattccttgctttgattcttcagtaatgatacgtgggccattcaacatttcaccatattcacaagtgtttgagcaatcatgtctcatcttttcgaaaccaccttcgaaaatcaaatcgacaatcatcttcatttcatgtgatgtttcaaagtaagccaattctggtgaatagccagcttcaaccaatgtgttaaatccagcttcaatcaattgtgtcaaaccaccacaaagaacagcttgttcaccgaataaatcttcagttgtttcttcttcaaaacttgtttccaaaatacctgcgcgacccgaaccaatacccttagcataagctttggcaacgtcagctgtgtcaccagtagggtcttgctgtacaccatacaaagaaggaataccaccaccttcaacgaattgacgacgttcaatgttccctggacccttaggcgcaataatcatgacattaatgtcagcatttggcttaatcaaaccatacacaatgttaaatccatgagaaaatccaagatatgaaccagctttaatgttaggttccacttctttttcccaaactgccgcttgtaattcgtcaggggtttccatcataacaacatccgcttgtgccgttgcttcagcagctgagtaaacttcgaacccatcttttttagcactatcaaaagattttcctgggcgcaatcccatgatgacatcaaatcctgagtcgcgtagattattcgcttgagcatgcccttgtgcaccatagccaataactgcaatctttttgttttccaatggtgttgtatcaatatctttatcataaaacatttttgtagtcataataaaatcctccgtgattttaaattcattttctaattaataatggcaaaaaccatcatttaccgttaatacatctaattgcttcaataagttacgtcgtaccgttgctgtttgtttgtcattttgagattcaaagataaatgaaattgtcgaaatcttttgatcttcatctggcgtcaccattagtgatttaatgttcagatttaaccgtgtcaacacactcgcaaaccttactaacaatcccggacgattgtacacacgtgttataaatgttttatccattaagcatcctcctcggtaatcatgtcacgataaggcgcacccgcattaaccattggcaaaacctttacatcatcaggaataattatttcaattagtactgacttgtccgattgaaaagctaattgcaaatcttcaagcattcgctcaggtttctcaattcgaacataattaataccatacgcctgtgctaactgattaaattgtggttgtgatttgaaaactgtactagataatcgaccattataaaatagtgtttgccattgtctcaccattcctaatgaatggttgtttaacaatatgatcttaatatttaagtcattatcgtttaaaattgctagctcttctgacgtcatttgaaaaccgccatcaccaacaaaaagtaccacctctttgtcccgtcttgcaaacttcgccccaatcgctgccggaataccgtaccccattgtccctaaaccaccggaagtcaacatctggtaattattctggaatggataatactgtgctacccatatttgatgttgaccaacatctgtgaccacaaccgcctcacctttagtaactttgccaaccgcttgaatcactgcttgtggcataatcgctgtttctgacttctgatagtaaaacattgaatctcttttcgcttgacgaatactttcttgccattttgacgtatctgtcattttggcatttttaatttccgtcaagattgcatttaacgcatcgtcagcactagcatgtatagcgtgagcggttggtagcactttccctaattccgtttcatcaatatcaatatgagcgatggttgcatgttttgcaaaatcatcaacattcgtaacaacacgatcatcaaatctcgaaccaatatttaaaacaaagtcagcctggtcaacagcttgattggctgctatggatccatgcatgcccaccattcccaaaaatagtgggttttctgattcaactgctccgagtcccaataatgttgaaacagtcggtatgtggtagtgctgtataagtgtgcgtagtaaatcttgtgcatttgatttcaaaacccctgccccagtaataataagtggctgacgagctttagacaaagccgctactaattgatgaatctgaacagcatcaacatccggtttttgcgtatcaatttgacgtagccagatatcagcttgactttcttcagtgttctttgccaacatcacgctctttggcaaatcaattaacactgggcccggacgaccagaaacagccaccttaaatgcttcttcaacaattaacggcaattcgccaactgttctaacttggtaactcatcttagttattgaacttgtaattgacaatatgtctaactcttgaaaagcatctgaaccaatagctgccgatcctacttggccggatatcacaacaagcggtacagagtcacaaaacgcatctgctataccagtgacggtatttgtcgctcccggaccagacgtgactagaacaacacctggtttccctgtagctttagcatagccttccgcagcgtgagcagctgcttgttcatgtcgaacaagtatgtgcttgatgtgcgatgattcatatagtgcgtcatatagcggtataacagctccaccagggtatccaaagagactattaacacctgctttctctaaagaatctagtagtatgtgtgccccatttttaccttcggttaatactacatttttcatagcttactcccttcttaaatttatcagccacttcgaaaattagtaaaattagattttgattaacaaagcaacaagtgtattgtgacaaatcgaattagtgctgtcaacgttaaaaacggaaaaaccatgaaaagagaatgatattaaaactaattatcacttggtacaacagtatttctgaaatgaatatataactttggaatatttaagcctatataaaaacggaatatttttagtaatcacagcaactaactaattataaaaatgatattctgaatctataatttcatttatttttaatacaaaggagagcagtatatgacaaataatgctgtattatcgatgaaaaatgtttcgtttgaacgagacaaaatgatattaaaaaatattaattggtctttacatagcggcgaaaattgggtgctgatgggactaaatggtgctggaaaaaccacattactatcattgatttatggtaatcattgggcaacaaccggaagcatagaagttctcggagaaacttttgggaagacaaatgttttagcgttgaaaaaacgcattggtctcatttctactgccgtacaatcccgatttccagaacatcatctagcccaatatattgtattgagtggaaaatttggtaccattggtattcacaatgattttgaaaaaaatgacttgaacgaagccattggactattaaagaaactaggcggggatgagttaattaataaaccttatcgtgttctatcccaaggccaacgacagttggtgctaattgccagggctttgttaggaaaacctgaactgcttatacttgacgaaccatgtaatggtttagatttattctcccgcgaattattgttggaacaaattaataagctcgctcaattacctaatcacccaaccttactatttgtctcccactacaccgaggaaattttaccgatctttaaaaatattatgttgcttaaacaaggtgaaatttttgcacaaggaacgcgcgataagatattaacagaaaacgtgctttctaagttttatcccaagcccatcaaaatatttcccgtaactaataatcgtttcgcggtatatccagctgaattatgaaatttaaatgtgaggttgacattatatttcttatatgatttaatttaagttaaataaaacgtcggagaaaatgctatgaataagaccataccagcaactacaaaactcattctcagcctcatcgtcattattacctaacgacaatgagctgatgtttgtactgcttattgtcattaggactatgagcagctgatatggtgatttacaaaaacccccaattagctaactaattgggggtttttattattcttgttatgcttatatttttgcgttgcaaaccaaaaaataaaaagaactcattaaataaactgtgttgtacttttacatggtttcgtttagtatgtagtcaatttagccataaaaaaaccaaccattaaaaataatagttggttttgataaaataattttaaattacttaagtggtgaccatgtccagtcagtgaattcttcgatatcacgaccttcgttacgagtaacttggaaatgctttgccaaagtatcatccatcttagcgatgaatgtatcagcagcagcttgatcaatcttaccatttgcagacaagatttcagcagcttccttagcttgatggaagcgatccaagtgtgaatatacacgcatatcatatgtcgttgtgatgtcaccatcttcacgatatccatgaacgtatacatcacccgtgaacttacgttcgaagaagaatgattcaatcaagttttcataagcatggaaaccgaagataactggtgtatcagcttggaaatacttgttgaattcttcggctgataattcacgttcatcattcatgttaggttctgacttcttttgcaaacgtagtaattcaacaacgttaacataacggaacttaacatctgggaatgcttggttaatcaaccacaaagcagccaaagtttcaattgttggttcagtaccagcagatgcgaatgtaatatcaacatcaccagaaggtgcagtagaagcccaatcaatgatcttcaaaccttcgttagccaatacttcagcttcttcaactgtaaaccattgttgacgtggttgcttagaagcaatcaacaagttaaccttatgacgttctgagaaggcacgttcttgaacagccaacaatgagttaccatcagctggcaaatattcacgaataaagttagacttcttttcagccaagtgagtcaacatacctggatcttggtgagtatatccattgtgatcttgttggaaagcagttgaagttgcaatcaagttcaatgatggatagtcattacgccatgcttgttctgaagcgtgacgcaaccacttgaagtgttgtgtaaccattgtatcgacaacacgcaagaatgattcgtatgatgcgaagattccaacacgaccagtcaaagtatatccttcaagccaaccttcagcttgatgttcagacaattgtgaatcaataatgcgacccgtagggctcaacaattgatcttgtggttccttgatttcttccatccattgacgtggtgtaacattgaacaatccccacaaacgatttgacattgtttcatcaggaccgaagaagcggaaacgagttgggttcaattgtgaaacagcacccaagtagtttgacaatgttgccatgtccatattgcgcttgctatcagcgaattccttaccacgtgtatcatcattgatatcgttagcgaattctctccagttaggcaacttcaagtctgaacgatcagcaccaccatttgtaatagggttagctgacatacgcttgtcacccttaggagcgatagctttcaattcatccttcaaagaaccatcagcattgaataattcttcaggcttgtatgagttcatccagtcttcgaattcaggcaatgttgcaagatcgtgttgttcaagaggcaatggcacttggtgcgcacggaatgagttttcaataggattgttacttgcatcgtgcgttggtccaccccagccctttggcaagcgagcaataattactggccatgcagggatttcaccatcttgatacttaccattttcacgtgcatcattttgaatagcttgaatatcttcaatagcttgatccaaaatgtttgctgcaagttggtggtatgttgcgtagtcatgaatatcatcgttttcgatgaagcgaggtgaataacccaaaccttcaaagaactttgtgatttcttcatcactcatacgtgagaagatagttgggtttgaaatcttgaatccgttcaaatccaagacaggcaaaacggcaccatcattcttagcattcaaaaacttaattgagtgccatgaagccattgaaggacctgtttcagcttcaccatcaccaacaactgcgaaagcaacttggtcaggattgtccaaaacggcaccaaaagcgtggctcaatgaatagcccaattcaccaccttcgtgtaatgaaccaggtgtttgagctgtcatgtgtgatccaataccgccagggaatgagaagcgcttgaacaagtggctcataccttcgatatcttgagtaatttcaggataatcttcagtatatgcgccgtctaagtaagcgttagtaaccataacttggccaccgtgaccaggaccaccaacgtaaaacatgttcaaaccatacttgttgatcaaacggttagcatgtgcatacaagaatgtctgacctgagatagtaccccagtgtccgattggcttaacttttacatcttcagccttgataggtgtattagtaactgagaacaatgggttgctcttcaaaaagatcatcccagctgacaaatagttagttgcgcgccaccacttatcaacaagttccaagtactcttttgaatcgaaatctgccatgagattaagtactccttattttttgcaagaatcataaacaccgtaaaccacgaacttcttccgttatttactcttacagtataaccgattacagatttttcttcaagggaaaaggttcaattgggtcaggtttttaaaaaatgtggttggctttttaattatattggaacgtaccaatgctgtaacttattcggagtctaaactcacgaaggcattatagcgaagatacttataatgtaaacgcattgtcgaaaattctagcggtgttccatcatccatgaagaaaatgccttccatgatgccgactggttcgttagcagttaattctagcaactcttggtcctcatcattagaaggctcagccataatggtcataaacgacttagttaccgtgcggtgctttgttttttcgatatattcataaacggatccggaaactatcgttctgttcagcccaggcaaaacattgataggtacatagcctcgttcaatcataaatggtaccccttctagtcggcgtaaccgtttaatttcatagacaaaatctccctcgtttaaaaaaagggcctgttgttgttcggttgtagccggaatgacttgaaaatccaacaattcaatgcttggcgcttttccatcaacacgaaacgaatcagaaacacctaggttagatccttcatgttggaaaattgcatggttttttagataaagcggattaacaaaggtgccactgccacgctttttaaagataacaccttgttgtaccagtacattaagtgcccgtttgattgatgagcgtgacacaccatattgctcagccaaagaacgttcgtctggtaattttaagttgggaaattcgccctggtaaattttttgttttagatccgcttgtacggtaacatagatagattctgacatagtaattattagtataccacacattggtcagaccagtcattgtattggtggacccaatttgtgataaaatattacttatgagtaaaaagaaaatgaaaaaaacgttgcccgaacaagtcatggacaaacacaaagtgaaatatgaaccacttgaactaaatatcttggataaaacgccagttcagcgcgatgcaatcctggaaacgtttcacgtgaaacatgatgacatttataaaacactcgccgcacatggggataaaactgggcccattgtagcagtgttacctatcacaaaacatctgtcactaaaaaagttagcagctgcatcaggtaataaaaaagtggccatgttacctcttaaagaattacaaaggacgactggttatattcacggcgctaataaccctgttggaatctggcagaacaagcatttccctatttattttgatctcagcgctgctgagcaacctttcattcttgtcagtggcggcgagttaagtcgttcagataaaatcaatccgcgtgatgttgcatcattagttggtgccgaatttgtagatttattagagcatgactgaattttcacttcaatttgcgcaaaatattggttactttttgattttacctatcataattgcttggtcaattagttttttgtctagcttattatcgcagtggctgacaattcacacatcttatacgataactgctattctaagtttttttggtgtggtaatacacgaattgagtcatctaattgttgccattatttttcgccatcatattactgagtttcgtttgtggcaaattagtgacgatggtgtgctaggttatgtcaaccgcgaatataatcccagtagtttttatcaaaaacttggcaatatctttatcagcatcgcgccaatagtaggtgtaacagctgctatttgctcactcataaaatttatatgggtaccaggtttatatattagaaacacattcgttattttaattatcggtagcctgttacttgggtttaacctatcagctgcagattggcaaaatttcaggcgtggtataccattatacttgattatcattttgttcatctcaacactacaatatctattttaaaaagcactagtacttgttcttctgtttaagcgagcatctcatactagtgcttttttaatttactgtgtattttactatctaacgtaaactaagatagtttataaatggatcttatatagttacttgactgttatctacctaccaccctggactaacatcaggcgctccagcgttcatatcattccgatatagcggtgccatagcattaaacttgaatgtcggtttattaaacatcaaggtagctgtaccacgagcgccggctcggtttttttcaaatataatttcaatcggcaccgcttcttgttcttcacgcggatccccgtcaccatcttcagaatcgccacgtgaataatcatctcgatacaaaaacgcgacaacatcagcatcttgttcaatcgaacccgaatcacgtaagtctgacaaaactgggcgcttgtcagtacgttgctccacacctcgactcaattgtgccagtgcgataattggtgtatttaattcttttgccatttttttaatcgctcgtgaaacttcagaaacagcttgttgacggctttcagagttattggactcaattaggcccaaataatcaattacgaccataccgattggatgcggattttgaatgcgctcttcttgagtcatgtcacttaacaaatcacgttccaattgatgtagcttggcactaatctgattaattttaataccagcagtatcatccatgtaaattttcatttgcgccaatgattgcatagcaagtgttaacgcctgccaatcttcttgcgtcatctgccctgtggttaaatgattagaatcaattgacccctcacccgcaagcaatcgaccaacaatatctgtcgcactcatctccatttcaaaaataacgacaggcactttttcatttttggctacattacgagcgatattcaacacgaaagctgttttaccaacggctgggcgagcaccaaaaacaatcatctgatcatttcgaaagccatgtgtaattttgtccatttcaggatatcctgttgataaaccaacaacatcactatcatttttaaccgcttcgtctagattagcttgatattcctgcagtacatctttaattttcctaaagttttcatcaccacgattttcagcaatggtatcaatactacgtgataattgcgctaataaatcttcacttggttctgcagcatcataagccaacgacattgttctcgttaacgtatcaatcatttttcgtaaaacagatttttctcgaacaatatttgcataatgcttcaaattggcggatgaagctgttgactctgatatttctgccagataagccatgccaccaacgttttcaagttgatgcatactattcagtttatcttgcactgtcaacatatcaattggacggttttcatccactaatgcctgcatggctttaaaaatagtttggttcgctaatttattgaaatcctcaggtaccaagattgcactagcttcaaccatcgcattttctgacttaacagcaaaaaagatggatccgagaactgcgcgttcagcatcaccatcttgcggcacttgccgatattcatttgataccggattatccatattaaccctcgcttacatgaacacgcaattgcgctgtcacttctcggtgtaatttaactggtacatctgtataaccaagtgcgtgtattggttgattgagttccatttttcgcttatcaattttgatttgatattgtttttctaaggcagccgcaatttgttttgttgaaacagcaccgaataaacgtccatctgttcctgatttgccagttagctcaacaactgtcttctcgttagcaaaaaaatctgctaattttctcgcttcagctagttcctcggctgccgctttttcttcagccttttgacgccccttaactgcgcccaagtttttgcctgtagccggctccgctttcttatttttaattagaaaattattggcatacccatcaggtacttccttaatttctcctttttttccgcgacctttaacgtcttctaaaaatactactttcattttttaatcccctatgttaatcttctgattgttccgcaattatatttaataattgttgtttggcttcttcggttgttacattagcaatttgggtggctgcgttagataaatgcccgccgccgccaagggcctccattgtacgttgaacattacgttccccagttgatcgagctgaaataccaacccgtccatcctgacgtttagtgatcacaaatgaggcatacacaccgctaatctgcaaaagttcgtccgcagcttgtgcagtaagcaaaccagaatagatatccttgttatcaccaacagcaatagcatttccttcatgaatctctgctaaattaaccaaatgacttcgcgatttgaaatccgaaaacttctctttcataaatgactgaatcaagttgctatcagctccgttagcacgcaaatagctagcagcatcaaacgtacgtgatcccgtacgcaaagtgaagtttttagtatcaatctgtatgccacctaacatcgccgtcgattctagctttgtaattggtgcatgtgactgatcttgatattgcagcaactcaacaactagttctgatgtcgatgatgcatatggctctatataagacatcaatggtttttcatctaaaccttgctcggctagacgatgatgatcaatcacaactacacggttggctaacctctcgagtaactgtggtgcaccagaaatacttgctttggcatgatcaactaataccaataaagtattatcacgtactagcttcaatgctcgcgcttcatctacgatagaatcatcaatatttgatcctggtgccacaaattctgctggctttttgcgaagttcagctaacagtagctggatatcgctgtacacatgtttttcgtccaacacaagaaaagctggtttattttttgtctgggccatacgccagacacccaatccagagccaactgcatctaaatccggcattgcatgtccgacaatcataatattatcagcctgctccattagttcagcaatagtttgtgataccatgcgagcccggacacgggtacgcttttccatcggattgcttgcaccaccataaaaacgtgccgctgccttttcagatttcacaaccacctgatcaccaccacgacccaaggccaaatctaagttcgtctgggccattttagcaagcttattaatatctgtgtcatcatatgctattccgaccgacaatgtcacaggtgagttctgttgtgccgttgcttctcgaatgtcctttaggacactgaacttatcttcctcagcttcttgaagggctgactgataaccaaacatgacataatgcagtgtattcaaacggcggatataaatatgatgttcgagtgcccaatcagacaatgcgcgtgtcacgtatgtccgtaaagtagacgtttcggactcgctcataccatcagtgacttcctcgtagttgtcaaccgatattaacccactgaacagctgatgatcttcatactttttagtaatcgcagcatactcactgatatccatcaaataaatgacccgtaagttttgttgaacaaataacgaaaactgcctaccctgccaggtgattgtattcgtctcggaagcatcggcataattatcaatctctagagccaatttattatctagctccgacaattctaatccaagcacatctcttttgtctagatatgcttgcatatatggattaatccaatcaatttttttatcttgattaagcagaataatgccaatcggcattcgaattaaagcttcttgttcactacgtgcaattcgataccccaagccagacaagtactcttgtgcatcttcactaacctctttgaaagcttgtgcactaaatactaatccaataataactattgccaaccaaataagtccaaatgttatattaaaaagcatagcaaaaataacactcattacacttgatacaagtaacagaaatgccactgtacttagtttagtgttttgaaagaatattggtaaatttttaaaactaaaaaatcgtttcacgtgctacttccttctgattatcatatcttctattttaccacagggtgtcatgattaatatgataatacttcagacaagccataacatggtgcgttagatacagctatatcccgaatttatacaaaatatacaaaaaagcctgaggcaaaccgcctcaggcttttaggaattaatcttccgtaacgaatggcaacaaagccatgatacgtgcacgcttgatagcagtagttaccttgcgttggttttttgcagaagtaccagtcacacgacgtggtaaaatcttaccacgttctgagatgaaacgttctaataattcagtgttcttatagtcaatatattcgatgtggttagcagcgataaaatcaaccttacgacgacgacgtggaccgccttgtgggcgacgtgaacgttgtggacgttctgaattttgtggacgtgagttttgttctgacataataaagctcctttcgtagtgtttaatttattttagaatggtaaatcatcatctgatatatcaatttctgtattgccactagccgcaaatggattaggggcactatttgacgaagctgatgattgcgtatttgagtttgaactcgcacttgcaaaaggatcaacaccgttaaatgagttgtcattaccgccaaacgaatgatcgtttgatccgctgaagttgtcagcaccattattagatgccgatgatccgttctgagaacgacgcttttcactttcagcgcgagattcgagtaatgagaaattatcaacaacaacttccgtcacgtaaacgcgttggccagcattattttcataatttcttgtttgtaaacgaccttcaacggccacaagtgcaccttttccagtgaagtttgcaaagttttcagctgcttttcgccaaataacggcgttaataaagtcagcttcacgttcaccacttgcgttggtgaactgacggttaaccgccaagctaaacgtaccgactgctacacctgattgtgtgtaacgtaattcaacatcacgggtcaatcgcccaattaatactactcgattaatcataattaacgctcctttcccagtgaaaatttaaatttattctgcgtcgcgcttaacaatcatgtgacgtaagatgtcttgagaaatctttgccaaacgatcaaattcattgatagccttatcgtcttctgcagtaaaattgataatgtggtatgtaccttcacggtaaccagcaatttcgtatgcaaaacgacgagtagcccagtcggctgacttttgaattgttgcaccattatctgtcaagattgcatcaaagcgctcaacaagagtcttcttagcatccgcatccaaatcagggcgaacaatataagtcatttcgtatgatgtagccattttatttcctccttttggtctctggcagccttggctgcaaggagtgatcgcacaaattgtgcattcacaactactaattgtactacaatatagccttacttttcaagtgtttatcagaattatttccactggtaacttataatacgatttttttgtctgtcttacttatatagatatgctgtcgaattacattaactacctatctgcttatgcaaaaaaagcccgcattgttaagtttgcgaactcatttatcttcgttatcgagtcatttcatacattacttgcgcgaaaatagcttgcgtcttagggatgttatctaccagtacatattcgtttggctgatgactcatgactggtacatcaggaaattgcccaccaaaagctacgccacgtttcaataagcgtgcatacgagccgccattagaaattttatatgtcttttgcgtatgcgtgtgctgagcataaacatccgcaagtactgtcacaattggatcactgaggtctaccatgtgcggatgtgtaccaaaagcttcctgcttaaatattttggcgttcaagctccccatatgtcgctgaacttgtgtcaaaatagcggtttccgttatgcccattggataacggaaattgatccgaatctcactatcagcattagcttggaataaaatcttacccacatttactgttaagtcacccataatatcatcatgataaatcaatccgagcttttcaccgaaaacgtttttatgatttgtcaaaccaagaaactctaagaatccatgcgcttgatcatcaaaattatagtttaataaaaaattagccaaatacgttgccgcattcaaaccatcttctgggtaagcgccatgaacagatttcccatacagtgttaatataatatgaccatcatcatattgacctatacccgaaatcattagtgtatctttgagataacgctcatacgcagctaaaaacccattgatatccacaccatcaggcagctcaacatcagcaactgcagtccctggtacaacattatctcgttccccagactgaaatcgatgtagtttccactcacccaatgttgtgcctttaaactgaattgataaggttagaacacctttttcaccaggaacaaccgggaaggctccgtcaggtgaaaaaccaaacgtcggttcacctacttgatccaaataggcccgcatatcacgccaatcagattcttcatcactaccaaaaatcaaacgtattttttttcgtggttgaaaaccagcatcttttaattgcttcaaagcgtaataactagctattaaatcagctttcatatcgtgtgaaccacgtccatacaagcgattgcctataactttagggctaaatggcaacgttatcgtccatgcatccccaccaggaacaacatcaacgtgtgacaagaccccaaaggtttccgttgcatcctctggtccatagtcaataacaacaaccatattatccgcgacacgctcaactttaaacccgtcacgtctgcccatatcaactagaaattgtagtgctgtttcaatacctgctccaaaaggttgttgaacattagctgttgttttatctaacacagatggtattgataaaaactgtaacaagtcagtcaataattctgatttgtacaattgcgacttttgttgccactgttcagctgtcatttgaaaggattccacatccgacctccattagttataaatagcaagacgccaatcacgacaatcaatgtcgaccatagaatcatagccacatcacgcatggaaaaacgttgttcttgataccatgaacgtttattatagcgcccaaagcggcgcaattccatagcttggctaatcgtatcaatccgacctaaacttgaaaatactaatggtagaataatttgtacagtccccttcatccgttggattaaactagatttttttgatatttcgtagccacgtgcctgttgggccaaactaatcgttcgataatcactctgtacgtcaggaatatagcgcaaggtaattgcaacggcatacgctactttgtagggtacgccaattttatttaacccagcagcaaactcactaggattagtggtgaaaagcaatacaattgacagcgggaatgagaataaatactttagtagaagattaaattcgtaaaacaactgttcttgcgtaattgtaaaccaaccgctaccaaacatcacatgttttgtaccatataattgttcaccatattgaggggccaaaacggtaatcatcacaaggttaatcaaaccaatgaataataccaactttaaaagtagcgcgtattcctgatatttaatatgagccattttaattaaaacaaatgacaatattgttaaagcaattaaaaaacgcgtatcataagaaatcatgccaattgttgttaatgctaaaaagccaactaatttggcggtacccgtagcatgattaatccaagtatttcttgctttatatccgaaaagtgagttatccatcttatttccttatagctgcatttaattcttctggatgcacaatgctaagacgctgggctaaacgataaatactggtagttcgcaaactagcagcgtcaactaatgcttcatttgcaagtaactccgctggtgttgtatccgccaatatttgcccatcaacaacaaccagagcccgttgaacaaagtttgctaataaatgcatatcatgagtaatgattataatagtcgtatggttcgtaatgttaatattctgtaagaaactgagtaactgagacgtgtgcgttgcatcttgtccagctgttggttcatctaatattagaatttctggttttaaaaccaaaacagccgcaattgtaagccgtttcttttgcccaaagcttaatgcagaaatgggccaattacgcataccatcaagatcgacaagttgtaacatttcacgcacacgttccgttacttgttcttcatcaatgttacgcaatcgcagcccactggcaacttcatcaaatactgttgctttcgtaatcatatgattaggattctgcaaaacatagcctatgtggtcggcccgttctttaatagaatcgcttagcagcgaacgtccatctaattgaatatctcccccactgggtgtcaaaaagccagttaataggtgggacaaagttgttttacctgatccatttttgcccacaataccaagaatttcaccttcatgaattgatgtcgacaaattttcaaacaatggttcttgctggtcgtacgcaaaggttaaattttggaccaacaactgcttgtcatcatgagtgactgtctgcactggttctgccaaagtttcaatttggtccctaaagtttgaaacgtccactttttcaacatctgctacgtgaggtattttattcactggaacgcctgctcggcgtaatagttgtatgtatagtggttcgtctaagccatttgcagacaacacgcctgcttggataatggcagtaggcgtgtcattagcgacaattctaccatgtgccatgacaattacacgatcaacatgagcacgtaacacatcttctatccgatgttcaatcacaaccactgtcatattacgttcttgttgcagttcatcaatcagtgccattgcagccgcaccagcagctggatcaagactagccaatggttcgtcaaataacaatagatccccttcatcaaccaaaacacctgccatagcagtacgttgtttttggccaccagacaatgattgcggtgccaacgtcaaacgttttcctaacccaaatcgattggcccatttagcgactttttctctgacaatttttatcggctgattatcattttcaagagaaaaagctatatcttcggcgaccgtcatgcccacaaattgcgcatcagaatcctgaagaacagtaccagcttgcaaagataggtcaaacaacgactgatttaggatctttttaccattaattgtcagttcaccagtaatatccccttgataggcttgcggaattaaaccattcagtaaacgcagtaatgttgttttacccgaaccagatgcaccggctattaaaactttttcaccaggataaatttgaaaactcacatcatgtaacgtcggttcagattgcgcgtgatatttaaatgtcacatgttgaaaatcaataaatggttctaccatgttttcccctatgtacgtagcccgtggctacttattcactacgcaatgagctcttcttaggacgtgacttgacataagccactagtaaaatagagccaataatagcgacagacaaaatgttaacaattgttgccgctgcgccctgtaagaacaccttactagctggctgtttgtatattaatatatcgccgattggcgcaacaatcaaccatgcaataacgttagcaattatttgccaaacattaaactgaactaacttttttgttgaaagatccccgccctcgaggtccaagaatcttttactcaaaccaagtaatagtccaaacacaccatcagctaagacccatgaccaccaaggggcaccataggtcgcgtcagtaattgtgtgtccaataacaccaactaaaaagccaacaactggaccaaataaaccagcaatcaatgctaaccagccttcagcgacgttaacattagtatttggcacaccagttggaatagcaatgtacttcattaaaatgaaaaacacagcagcgccgataccagttgcaacgactgaacgcaccgataatcctgtttttttgttattttctttcatttttctctccttttctttgagactatcatatttctttggttaatgaaacagcccatccttggccagcacccacatggtacgtttgttcaaaactaccagtatgcaaaccaaacgcaactgtatacactgaatcaatataaattaacggttcgccaggattgacatcggtaaatgtgtgcacatatggtagcacctcatcaaataacaaactaccatcacatttaatttgaacacgcagggtatcaccatattgcaaattcatcttttcaaattcgcgtaggggaatatttgaccacagcgaaccaaaattgacatcagtgatatcaatattacccactaattgtggttgcccataaaccgtttcttgataaacaccaggtgtaattggtaaacgtaccaaatcgctaactgataattcttccgtgtagtcttcaaatactacttgtccactagctaatttagccccattataagcataaatatcacgcccatgaaatgttgatgatttttctgaaccgggaaggcgttgtgttgtttcatcaatcacacgtacactttcgattaaatcattagataatagatgcgataaagtgccgttatctggtgtcacaatatagtggccagctgtcgtcttggcaattactgacaaacgttttgagccaaccccagggtcgacaacagatacaaaaactgtgcccggttgccaatagtcaaaagtttgaaacaatcgaaacgacccttcaaagatattaaatggcgtgataccatgtgttaaatcactaacaacaatgttatcggcaacattgtaggcaacacctctcatggagcttaccgcaccatcctgtaatccaaaatctgtttgtaacactaaatgattgtttgtcattttcaattcctcggtcatcttattaatggctttctagtaggttataaaaatcgtaagaaatacaaaaagtccctgttagtcatacagattaacagggacgtaaaaaacgtggtaccacccagatttagcataatacatgctctcatactgtaacggcgctaaccgaccgcgaaacttaacaacttaaatctcacgatatcatccacgttcatcttcaataaactgcttcatgtcagcttccactatcctgactcgcttgaatttccgctcgttatctactcttcgcttcaacgattttaatatcctaataataccttaagataattatgaatatttgtcaatacgtttatgattaaactgcaataaaatcattaataacctttgcaaaatcattatgataaatttcaaacttcttttcacccacaccagagattgctaagaactctgtatcagtttgcggacgcgcctgtgccatactcattaacgttttgtctgagaatattaagaaaggtggcaaaccagcggcccgagctaattctaaacgtttttcctttaactttgcaaacagacgattatcttcgtcggaaagtttcaaatcatcagtagtcactttctgactgacaatacgtaccttctcaagacgttttttaatctcaatttcaccttttaatacttcggcccctaacgatgttacttttaacacgggaaactctgctccctcgaaacgtaaatatccttcagccgttaagtagtcaataaagcgcgtcaactcttttagcgttcgctctttcatcaaaccaaacgttggtaaatcatgtaaaaactcatacttacgcacactagcatcatttgatccttttaaaaccttagcgaccatcgttttaccaaagcgttgattcatacgcatcacattagccagcactttttgcgcatctaccgtaacatcaacccactcgcgcgtatctaaacaattcgagcaatgaccacaatcttctgtcaccgtttcaccgaagtattgcaataaataccgtgctaagcaagtttgcgtattagcaaaagcgttcatttctcgaattttgtcatattcattttgcttgtgttcttctgaaccttctgacttttgaacaaagaattcttgcagatgcatatcctgtggtgcatataataatatagcttcggcgggtaacccatcacgacccgcacggccaatttcctgataatatgcctcaatgtttcccgggacggagtaatggattacgtagcgcacatttggtttattaatacccatcccaaaagcgtttgtagccacaataactggattttcatcatatagaaacgcttcttgctgtctttgacgttccttttcagataatccagcatggtaacgacctgcattaatgcctattttattcaaataagtggtcagttcatcaacttgcttacgtgttgctgcataaataataccagtttgttcacgatttttttgtaaatattcaaccacatactttcgtttgtcctgattatgtacaatattcaaagccagattatctcgcgcaaagccggtcaagaccgtatcatcatcgtctacttgtaacaattgttgtaggttttcacgaacacgctctgttgcggtggccgtcaaaccaagaactgctggatgtccagaaatttgttccaacaaaggtagaatattcagataactcggacgaaagtcatgtccccattgtgataaaacgtgggcttcgtcaacagcaattaactcaatattgagactttgaacaaaactaaaaaagctagggacctctagtcgttcaggcgcaacatacaacattttgtaaagcccatgtcttaggtccgacatacgttgtgcttgttcttgcccatcaactgtcgaattcaagaacgtcgcaggaatgcccatggtgttcagcccgtcaacttggtctttcattaacgaaattaatggggaaatgactaaggtaatgccttcaaacatcattgccggtagctgataggtaattgattttccaccaccagttggcataatagctaaagcatgtttatgtgcgagtactttattaataacatctagctgaccagctcgaaagttatcgtacccaaatttttcttttaaaattgtttgtggattcgcagtttgcatattttctattatagcatgtgccctctaactaaaaagcagacgacgattagttgtcatctgctcccattggatttaattgaaactttattggcgttatacatcttagcaaccagttcataattgctaagatgcctgacacaagcgttaacaaccaaaattgctttacttgaaaattactaaacaactgtaatagaacaaaaccaattgcaaaccagccaaagtacgcagccatcgtattgccaccaattcgcaatactttatctaacaagttttccgattcattctgaaaaaacttaacatgtaaccaatcgaaaaaaagcatgataaatacaaaactaaccagatccatagaaacaaacttcaatatcgttatataatctcgcatgggattaaaacgtgttgatccttgatataacaacaaaccatatgtcatcataatatccgaaccaaatatgaataataaccaactaattggcttagttcgtaccatatcccgaattaacatatatcccccaagaattgactcaacatcatgattatcttaaattattatatcatttatcgggttctttaaatggttccggaacaaaacaaaagattatttttgattgcatagggtctttctttgacccctagtaacagattatgagacaaccgcaattgttttaaactactcgaaaatgacatacctctgaacttatttttattagtatgaatgaaagaatagacgttcatcaagcactttaactagaagtagtatcgtgttattcgagatatattgattttgatgactttacgtagattatacaaagaagaaaatacctaatatgatttacttagtatttgctttttataatgctgactatagtgagttactagtattattcacttttccccctgttatttaattaacaccagatccgacaaagcctctaatcagaccgtctacaatgtccattactggcataatagcatacaaaaatagaagaaagccgatggcaatgatgatctttttatttaaaatgctaatcaatgaatgccagttaatttttgtcagaatgtagataattagaataaacattggaatagataaataaccagataggttagattcaattaaaatcatattcgatgaatagaacagttttaaaaataaataaccgatagttccaactataattgcactgattaagcttatcgtaacaatacgataaaatttgcgttcctgttgattttctcttaattttccgaccatcgtttcgtctcctaaaaacaaatcatctaacgatatgtttaagtacttagatattaaaataatattttcaatatctggcaatgttttaccggtctcccaattagatatggttttattggatactaataacttattagccaactccatttgtgttaaagacattttttgtcttttttcctttatcaaattatgaaatatcacgactttcctcctggtccttgttatgacattaaacataataccccgtcgctattttagcaatagaaagtccttaccaatccttataatattaggtttcatcatgttattgagagttaacaaaattactttaatctaaaattatttcacgacttgcttgattcaaacctaaataagttaaagtcatcgcttcactagaatggtttaataattgcatgacaagtccgatattatagttagactgcatgtagacacgataaataccaatttttttgattgtaggtaaacgtatttttcttaatcgtgacatctgcgttaaacacattagccttttatcataacatcactcacccgtagtaaggttgcttccccaacttgaaatacggtgtagttacgacatccagcacgaaaactatcaaataaggtatttttgatcattttcaagacattagaatcttttatggagtacattttgttgcatatttatttaacctcaataatagggatatccttgcttggcttactcttttcaaggaatgaccaattactattaccataatatttaaatgtaaattctttaatctgaaaactattttgacctttcgacttatcactgatatctctcagaaagttaaaatataaatgcctcttattttcattttccgatagatctaagaactcaattttttgtttaaacccaggagttgttagggtattgtgcgtcttaaatacttcaaatgatactaataattcttctacaatttgacgcatagcagaatataggggattaccgttaggataattcccgttttgatcatagaaaccgagtaattgtgactttttaaaatcgtcaataggatcttttttttcatctacatgtgatccaccatctttattagctatgaataatacaatatctctacgagaaatatattctgattgttgtgcaaacacaatttgttgccaccacagttccacaggacaaaaaacttctgaaagaatcttatcagagctgtctcgacgattattaaatacttccttacttcctaacggcatgtaagaagcaccttccgccccaattgacatcatcaacagatcccaagaaggcaataaattattgggagaaaagctactgttaggtgaatgccaagctttaaatttatttattaaatctagttgatttagtaaagagtttgaattgtgggtttgatgtattagaacgcgaacctgtgtagccattggtagcgccatatcagttacaccagagtcaaacatttttgcatagtgacgaagtaagtctagctgaacgtctagtttattatttttttcctgtattgatagtttttgtttagacatataagccctccacttcgagaattattatatcatttaactaaaaaacaacccctatactcaacaatcagagtataggggttgttttaacgggtttttcgagggattatttttttgaatagcccctaaatttggtataaacttagtggttaccaaaattcataccaaagccataaccaagaccttgatatttgtcagcaaattcttggcttattatctgtaaataaaacggggacaaaggtttagaaagactatttttcatggctaatggtgttaagtctgtttttaaatcagcaattattttaggtagatattgattattttccaaacttaattttgctactatcagagcttcccgttctgtttggttaatgctttcgtccaaaattagatccgtaatttggtttaacaaatcgatttcatcattcatagttcagttccccctaaaatgtttacatactatctctttattttggtaatgctaattatgttaagtctttaaaaataattaagttgtatttataaaaacacaacttaatcatttttttcgtaaataaataatttatctacggtagaattaagttctttcgctaacttaaaagccaaaattaaagttgggtcatacttattattctcaatcgcattaattgtttgtctagaaacttcacaattatttgccaattcttcttgagataaatactttttttttcgtaactgattaattaaattttccaaaataaccgcctcagtcacccattttgttacgattatatcgcactgcgaataaaaacgtaacaactgcaaatgttagtgaaaaaaaatcatcagagtgatttgtataattatcaaattgaatatttaaaattggacctaataggaatgtcaagcattttaacgtcaaagaaataataacaacgataaaagaaaaacaaccactttttaaaataatcatatgttttctttcatcaccttttcttagtaaagatgctacaattcctatgtcaaaaataaatactacaatccctattatccataatgcaaaatatcctttattcataaatttctcctcagctaatgtaaaaaagatttaacatatataatatagtatattatatttgataatatcaaatgtttttgacattatcaaagtcgttataggccactatatgtcactttttttgccgatcacttgcgggcacgagcctacccatatccgaattatttatcccccacaataccgttatttatattactttgaacgtgttttagactgttgtggtgcaaaataaaaatcaaatgatgatgagattgaattatggaccacttcatattctttattatgtttaatgctcaggcactctactagtttaacgagtatgagtgctttttttatttaacttcaagttctaacaactcttgtaaatcttttgttgttgctgggttagctgttttatagtcgaatcgtttgcctttgagaggaacgttgccagtataatcaatcaatttaaaccatacacgtcctgcatcatcaccagttaaatgataccctgcttcgtcacctaagctataatcagctacaaccttttgttgatacatagcaacaacatgagtaatgtttttcttgattattgtgtcaaggttaatacgccaagcacctgaaacacgtttttttagccaccctgtttcattcttgatttcactcaacttaattatgagtactcgttctttattcatatctgcctcctaaatttttatatcagtaaatcattagtttactaattaatacttttatattacataatttaatgcaaatttatatgataaaataatttaaataaatttttttgggagaacctatgaagaaatggtacgaagagaagcgacataaagacatgttattttatgttgctatggtaatattagttattagtccattcttattcaaaggatataaattaatgtttggatcagcaatagcagtattaattggcttttatagtgggcaggactaattatgaaaaaatggttatataagtacaatccgttactgatgtttattttagggtgtttactgctgactgatgcaatagttagtaataatgtcgtaaatatgatttcacctagtatattaataatattagctatttacatcactattgtaagaattattcgtaataagtagtcctaatcgtttatataaagcccataaaaacgttttaagcacatgtttatattcaaatgtatttataatgtcttaagattgattatattgacaaaaattttaatatatacaaaaaagcccacaaagtaatgtgagctttttagttatcttcaaccaaaaaaacgtaaattatataatattccatagaaccaatcttgtctgtgaagttcttgaagtaatattttaccttcatcagacaggcccactaagagacatggtttggagcttattaacagtctgttgaatttcacgatactgtagtgaattaggcttattcaattcttcaatagtatctaatatcacttttttctcatcactgcttaatttttgatggtttttcaaaaatttatttaaataattccgcttgtctgatttaaacatagcctctctatccctttaaattaacgtcctggggcatattgcccttttaaccatcggtcataagtttgttgatatccatcaataataacattaactgtgtggtcagtaaaagaagttacttggaccaatttgtatgtatcaatagttctattataaaaaagagcaaatggttgagcagtgaatattctcaacgtccttttgaagctccgccaccactatacatttgcactttactttctgcaaattgactagcaccaactgaattgcttacttgaaaagtgtttgttattgtatcagctgataccttagaatcaaccgcaaaaccagatgcaccaactactcccaaattacctaaaaataaggctgtagacttaaacatgttcataagaatttccccctagtatttatattttgttataaacataaattactatctaaacacgaatgacaaacgtatgtcaaaacgttttgtgaaattacttacttttaaaataaaaacccctacagttgtagaggtttttataattaaataccaggtagtttattatctagttgatatgtttgtgttaaatacttggcaattgggtataagtcatcaatgtacataattgccaaaccatttaataccttaataataattacatcattaacatttttaaatatttctggctctattttctgataaaatgctttaaaatcagctatggtatattgactaatgtcattattatgtactaacatatgtgttcttgttaatacattggaaaaagtttcctcagtacctccaaggtcttgtataacaagcgctattgacactggtcttatatacgaatcccctagaaatgttgccatttccattaatatttgtccttgtaatctaacatcttcaaacatttatatacccccaattaataagctaatattacactttaacccacttgcaataccgcgatgcttgttatcttccatacttccttgcaaacctctaaattttgaaatctaaaggctgtattctgcactatgttcacaatattttcacataattcatttttttataagcatgaatactattaaacctcaatggtaaacgtttgtcaataattttttaaattaatcattactcctttggaaggtaagctattttacgaaacctaaaatgaacccgctaactttacgaacatttaatttgttcaagttatcgggttcattttattgatttacgtaggccttttttattatattaggcgtgcgtaatgtgatttcttgattgtgttgatgactgaccataataggcattatcgccgtgcttcctataataatgtttatctaacaagtattgcggaacatgaatttctgatcttgttgactgcaaagcatggtaactaatttctgccgatacttcgagcactttagcgttgtatacggatttctctggggtcgtgccccatgtaaatgggccatgttgactgaccaaggcagcaggcgtcgcgtctgggtcaagcccacgatgctcaaactctgatacaataactttcccagtatttagttcgtaggccgtcttaatttcctcttcacttagggccggtgcacaaggaatatccccataaaatgtatcggcgtgcgttgtactgacagctgggatatccatttttgccgcagcaaacgaaacgccccaaggtgaatgagtatgcgtgataccacctatatttaaaaagtgttggtatagataggcgtgtgtaggcgtgtcactagatggattgagattaccttctacaacttctccgtccaaattaaccacaaccatatcggaaggttttaattggtcatactcaatgccagagggttttattacaaatagccctttttcacgatcaatgcctgagacatttccccatgtaaatgttactaatcctaatttaggcaacgccatattagccttataaacttcatttttaagcttttctaacataattacacctcgatgaaaattccagattcggttagtaaatcaactataaaatcatgagcgttctcaattttattaatgcaatcgttctccttttcagaccacatttcaattgtaaatgtaccctgataatctagtcgtcttaacgtcttaaataatcctaagaatccaacatttcctgttccaaaaggtacgtttttaaattttcctggtgtatttgacgtaacagctagcgtatctttaacatgtatagcaataatactgtctaatccttctgtcaaatcctctcctggattattttcaggccaagctgaaatattgcctaaatctggatatgcctgaagccaaggtgaaacaacggatttcttaatcttcttcaccttagcaatcgaattaataaaagtgtcatccattgtctcaatggaaatcataacctggttttcagctgcaaaatcaactacccgctgcaagttttcaatgaaattttcacgtgttaacactgtcttagaaccataatactcatcatatccagcaatctgtatgttcctgattcccaggtctttagccaagataattgctttcttacacatgttatatgcttgagcgtatatttttggattctcagatccgagaggatattttctaagcgcggacagcatcattgtatcaattggtatgcctgtttcgtacacatctcgaactaactgaaaccgttgttccttgttccaatctaagcgttcaatacgttcatctgtctcatcaattgagatttctacaaaagagaatccatgtttttttgctaaattgagtttatctcgccaagacatctgaaaaggtaatgacttctcgttaattccaagttttgccatcgttacgcccaaaactttttaatctcattttgaaaatcttgggctgtcttagcaggatccttttgccctgtaattgcacgaccagcaataaatgtgtatacgggaacgcctttgaataatttaatcgtatcgatatttagtccacctgtaacagatactttgaaccccatatccacaaaacgttttacaatgtccaaatcttttttaccccaaacctctcctgctaataatgcgtctcggctttgatgataaatgacttgttcgataccaattttttgccattctttagcccggtcccagttccatgctgaatagagctcaacttgaatgccatccaacacagatttagctgatttcattgttgcaattgtagctgaatcaattactgtcatcaggtcagccccagcatccttagaattttgtgcgactgtcgaccccgcgtcagcacattttgtatcagaggcaataatcttatctggaaacatttctcgcagtacgcgaatggcttgctggcctgcttgtaattctagaattgtcccaacttctacaatatcgacaattggtcctgctagatgagcaattcttgctgcatctgccaatgtattttgatctaaggctatttgtaaattaggtttcgtcattatcatatcctcactttttatatttttcttcaaaatctgtttcatcaatgatgcgttgggtgatttctttatcgctcataacattcttcacaccaacgaccgtcacaccttttttactggcatcttcaaacatactgacaaagtttaaaggtgtgaaaactgcgtcatactgacttgctgtcgactttccttcagcaatacttgtatgattaatcttactgattggaatacctagttttttcattgatttttcaacactcttcatcatcatcaaactggtacccgatccattggcacaagatactaaaatattcataataatttctccatttctttttaattacaaattgttttattcaattcccttattttctttatatgcatcgtaatcctcaaccattaagaaatagttttttggatctttacgatattctagttgaggaatcaagagtaagattgccgctaccagcactactccaaagtaacctaagtatttcaaaataactgtaaacactggccaaaccgtatcccaatcaaacatacccaagtaaccaccaaacttagacataccaatccatgttgaaattagcgcagcgccaactacttgaataatgcctgagaagaagggtaatatcatcgccgcttttgcacccgcacgattattggcaataacaccaaagaccgcattatcgaagaagagggggataaaaccagcaattataattgttggtgaatgaaagatcatcaatgcaccaatagctaagaattggcccaatgcaccaaacaagaaaccgattgttactgcgttttgttctccaaaagcaaatgttgctgccacatcaattccaggcacagaatttggcaagattgtgtcactgatacctgtaaagctttcagttaattcgccaacgaaggtacgaacccctagttgtaaaattgccaaattgacagcaaatcccaatgatgtagtcaaaatgtagaagaagaaactagttccttgggctaatcctgaagtccccttactagtaataaacaattgatgaaaatagttttctcctaacacaaccatgatgattccaaagaacaagaacatcaggatagccgttgctaccatgttttcattgaatattctcaaaaacccaggaagcgttatatcttctaaacgttttgctgatttatttttgcttttatcagaagactttttcattttgtcggaaatccacgcaaccaaagcaattccaaacatttgctgatgcgcaatggcaaatccgccaccatctgtaagttgttgtgttgctttgatggtcatattcgatccaaccgcccaatataaaccgagtaacacgcccatcaccagcagcacttcaattcgtcctaagctaggaatggcaaagagtagaatccagaatgctgtcgcagcttgttgcacttgaacatttcctgttgtaaacactgctcgtaattttgtatattttgaaaatcgaacgagcaaaatgttaaaaacaaatgcaatcaacaacagaatcatcacatcaccaaacgaacggccaaatgttttctctaatccatccgtaacagcattttgaccaaaatacggatcaattactgtcgctgtaagatgaaaacgatctttcaaacctgttaaaatcggacgaaaactggttactaatccgtttgaccccactatcaaaatcatataaccaatcgtggcttttaaaaacccagccaaactttcataccaaggtttcttttccaacatatacccaatcaatacaatgaaaccaatcatgtatgctggctgagttaaaatattatcagcaaagaattcccaaatttttaatattcctgctagtatgctatccattttattctcctcattattctgcagggatactctcaaaatgattcataacttgattaaaatcatctagtgtttcgatattagataacgcttcaatcatgccatcggtcattaataaagccatcaaattttgaatgttttctaagtgttgttcttcgtttttagcagccagtgtgaaaaatagttttccttgtttttctggatttccttcttcaaaagacaccatctcactgaatttagcgaagccaatacctgtacctaaaacaccgggtccagtagccaatgcatgtggcattacaactcctggaactatcacaatatacgccccattgacttcgacgtttttgatgatttcatttatataagcgtcagtgataatttctttttcctttaaattttcactggcaatacgtagtgcttcacgccaatcttgcggtgtctcatcataaatacgtaccaaatcattatcatgaaaatatttaagcatcgtcattttattgctcctttagaggaatgatgggaatggcacatcattgtccgttgaaaagacatctgaaaatcctcgatcataatggtattggagttcatccttatcttgtggaaatgtatagctcccgccaaccttccatacaaatggatggaactgataattaagcgtgtccttcttcatttgccaaagttttacaatttcttgtggatcagcatcaaagttagaccaaatatcatagtgaactggaataaccacctttgcctttagatcttctgctgaacgaagtacatcaattgacgtaaccttatcagtaattcctcttgggttttcgccataattaataatttcaacatctatatcattttcattaccatgcttagcaaacatattagacatatgggaatcagccgcatgatacaaattgccaccagatgttttaagtaagtagttcactgcaatttcgtccatatcctgtggtaaagcaccattaattttcacatctggctctaccgttaataaagctgtgcgatcgaaggcttctaaagctttaatcgttaccgattttaccgtgacctcatcccctggatgaactacaacagtacgatcagctggcacaccccaactttcccagatatcaacgactgcctgaggcccaataaactttgtttcggggctactattttgtagcacagctgctgctgtattaatatctaagtgatctgagtggatatgtgttactaggagtgcatctacgttttttatagcatatgggtcaataacaaatggttgcaaacgtagattgggttgcattttttgaacaccactcattcgcatcatctggtgcccttttttcattaaaccggacccatgcgattgttttccagtaccgttccacaaatctactaaaatgttggtattttcgtgtgttttaagccaaacaccattattggccagccaccacattcggaaattattttccggtacttgtgatgcttcaatttcttcgtttaaccaagttccccactctggaaatgtattctcaatccagttttcacgtgttgcttcttgaacattctttgcttttaccatagtatttaaaccctttctataaataactaaactttaaatgtatgcgcttacattatttgctacaactctattattaaacatgataaaataaaaaaacagtcccattccgccacaaaaagagcgctctaatgagactgtttaccttctcttccacattgtaaaataaacataaactagggatgatattatttgttcacatataggagaggaacgattaaaaatgcaagtgtcaaacatgaattatgcgaaatttattaattatatagccacacaagaactattaccgaacgtacagaccatggcaaatcgtttgaacttgtctagccgtaaaatttattatctacttcaggcagcgaattccgatttacgttcatcaaaccaaccttttcttgttccaagcacaaaaatttcagattctcaaatttctgtattaaaaaataagctatcacacgcgccatccgatgaataccttacttcgtatgaacggcagcagatcatggatatttgtattgccctccccttaaaaaaatggactctatctgcatttcaatctttatttgatgtatccagaaataccgtattacgcgatatcgcagatttaaaaaagagaaaaaaatttcgtcctgaattttctaagaaaaatggttttgagtttaaggaacctcgctatgatttattagtccatgcatataacagtctgatgctactgcaaagtcacagaaacccgcttaactactttattcactcactagatggagaaccctctcactccaaatttttactagtcagtgaaaaattgaaaaatatgtacaaagattctttggaaaaaagtatctctatttctaatgcattgacactcactattttttctgttgtttcttcaatgtatagtagccatcatcctattactgaagaaatgctgttcaatgattctgatattacatcatttacaaatcggcgagaacataatatcattcaagactatgctcttgtagcagaaactaatttttcgattcacataccaacttctgtgaaactatttttaacactacaacttcttagtgttaccaaagagcaggatgatcactttagctcacactcgtttcaagacctcttgattctaagtgagcacattgttgatgcttttatgactatttctcacatcaccagtaaaaatactgaaagaaaaatactgatccgagaaatacagactcaactcaaaccgttttggtacgctgttcgttatcagaatattactgtctacgaatatttatatcacgaaccactttttgaaaagtatgttgtagaatccctaaatcaattaactgatagcgctttatataaccatttatttccttacggtttgcttccagatcaaatcagtgtcctagccatgatattctacaatttcagcctatctcagcaaaaagagaccaaactgaacatattgatggttacatccctgccaatatacagccagaacttatttaaaactgtcattgaaaaaaacagtactgtcccatgcgcactgactattcatgcgctaaatagttttgataattcatcaaacaatgtcaatcaatttgatttaattattactgaatctaccgaaatcagtaccaaacaaccaacatttctaatcgacagtgaattgaaagaaagtgagttcgatcgtcttaagactgttatatcacaaatcaatcctatggagaaaataacaaatgacaaataaaataaaaatgattgccctagatatggataatacactgcttatgccaaataaaaccttatccgaaaggaacataaaagttctacaaagtctacacactatgggaaaaagcatagtgctgaccactggtcgcccattccccaacgtgcagcctttcctttcacaactgcaattgaatcaaaataatgattacgccattctatttaacggagcaattatcaaaaacatatatacaaatcaaaatctaatcaatcatgtctttactctttcagacgttgatgaagtgtttaacttaatacataatattcgtttgccaattgaccttgttacgcaagacagcgtatattctattaaagattttggaaaatctgggtatgttgaattagtagggaaacttattccttattcagaaaaacttttatctgaattaactccagatctgatgtttaataagtttgtcgtctgcgccacggacgcagagttaaattatttagaaaacgttctccaacacacgcccatactaactaaaaatataaattttgtcagatcaagaagaaatttattagagtttgttccaaataaggttactaagggcgctgcattatcaaaactactcaaacagttgtcattgactccagataatttaatggcctttggtgatgaagcaaatgattactctatgttgagcttagccagagtttcagtagctatggataatgccatcccatcgattaaaaaagtatcaacaaacattactaagagcaatgcagaagacggcgtagctgaatttttggaaagttatttttcattgtagtagttataaaataaatcaattttctctctcaatcgaaattcttgacaaaaccatacaattttcctaggataatatctatgttgattaaatcatatgtatcttatgattcagatatttctcagaaagtggtgaaaccgtcatgcctttatttattcttggattagtcattggttttggcttgcctatacaaaccgcagttaattccaaacttcgcagtgtgcttggttctgcatttaattcttcgttagtttcatttggtgttggaacactttttctaatagctgtaacactagtaactactcattctctcacgattagtgattcctttttttcaactgaaccttggtggatttggattggtggtgcgctaggtgtcatctatttaaccggtaatattgtcttattccccaaattaggtagtgtccaaactgtcattatgccaattcttggtcaaattgtcatgagtatgctcattgataattttggttggttttactctaagcaacatgattttacttggtttagaggagtgggcgccctactagttttagccggcgtctttctttctgtttcattaacacaactagtattaaagcaaaaaaacagtccaaaagaagcaacttcacaaaataatgagtcaaactacataagattaccttggcaatttctgggatttgtaaccggtatgcttagcgctctccaaacagctattaacggtcatttaggtaaagtaattaactcctcacttaaggcagctcttatttcattcttagtcggattcgtaacactgcttattattgtcttaataaatcactatgctcataaagcaaaacaagctatccaactttcacaacaaccttggtggatttgggtcggcggtatcattggggctctatttgtcttaggaaatgtttatctagtgcctttactaggtactggattggtagttgtcattgtcttagttggccaaattgctggcagtttattcgtagaccaatttgggtggtttggagctaagaaaaatcccatttcagtcattcaacttctgggtttatttttcatggttggtggcgttatgttaattaaattcttttaaaaagtaaatacaattattcaccaacttaaaataaaaaatataaaaacgtaaaacacctataagtgtcttacgttttttattaagtgtcgacaaaatacattctgacattgtctattgcaaagttcaaagtcccgtattcatccactgtttaaaatgattaaccgtactttgtggtacatatcgcaaatgaataatatgatgcccattgccatcccttacaatgacatcaaggtgtagtgctttttttctaaaaactgttatgaacccgctttctcgcaccccttgaattttatcacgacgaatataataaccttccttgctaaaaccattgcttcgctgtatatacactaattcttgattaaaaccaagcttttgatcggtaatcgtcagtgtgttcttcagaattagtatagctgttatcaccatcatgatgatgaagaagagcaacatatatgatctttgcaacatacttggaaaataaaacatgacaaccgaaattaccaaagtcattataagaatgttgcgcaaaacactgaaacggacctgataccaagccgctttatcaatattactcacttgccaatgatctacatcaaaatcaatagacgttaagaccttttttaaagtggtcatgattttatctattgacgccacaggaatcagaaccgtttgggcatctttttcatcctgactcgccgaaagcaacacattaacactcactaatcttaccaaacgccttaacattgtttgacgaagttgtatcgtttgtattctattaagttttagttgcatcgttttatgcgctaaaaacccacgtgagatatctaaatgattgttctgatgttcaattttaaaattaaaatatcgattaaatattctgaaaaaaccgataaatataccaacaatcacggttaagacaaaaagaatacaaagtcctgtcacagattgatgattaaagaaagcttcaaaactcgattttaaattctttggtaacatctcatcaacttgagaccaaatcgtgaataatacgacaacgccacctaacccactcaaggatgtcaacgcatagacgatcaattcctttacggtcacctgatattgaagcttcgttgtttcaattgtctcaaattctttctgaatactattttgagcaacccgacgtttttgttcaattaggttagcttgttttatagttaatgcatcaaaaatcacatctggttttccttgacctgacgtatcaatttgcatgcgcacaacatgaaaaggttgatagtaaaaaggtatcgtacgcgttatcgtttgaattcgttcaaatggaatatgcagctgatttttattgaaaatacctttttttacagttaattcgtgttcatcaaactcaaagataaagaaaaaccactgtacccaagcgcttagtaacagaagtaataaggtaacaatcacaatgataggaaaatatgtgaatcggctctcattcatattgaatagccccaaaagagccggccatataatcaattttatattagttaacaaatttataaaaatagcaaatagactttggtgttgtttaatcatcggaagctacctcacgtgcatgtaaagcagctattaccaattgacctcgcattttttttgcggtcaattcctcaatttctctaatcttaaaaccatgtgcagcagttttaattgacaagtccattaatttgaactggcgtaaaataggtccttgtgttgtatcaacattttgaatacgatttaaaggaatagtttctacttttctaaatacaaatcctcgataaatataaaccgcatggtcatctatgtagtaacgcctaaaatggtaaaaataattaatcaacgccatatgaataagcggtatcgacacaactattaacatgaagactaaagcaatatttgtataaatatcccttttcgattgtaaaaaaaggatatagacagtggctagtcctataaatgtaaacaaaaaccaaatgacatcatggatcaaccaaacgaatttggctgttttgggtaattgcacggcatcttctggtatcatattcttccctcgatcactctaaaattataatatttagtttatcaaagcaatttaccgaatgcaaaaaagtgacataaatagctgatagattttaaagattaaaatataattaacagacttaactattcatatttatgcaagaattcttttaaaagttgaattgttgatgtgtaatatgtcacgccataatcaaacgccaccttttgcacatccgtcatgccattaccttgccactcatcaagttgcgatttcaaatcattgagttgcaactgtttacggtttatttcttctgttagaaattcttttactttttcggattccaaatgattgctaaaatataaacgcattaaaaaatcagattttaatacttcaggagaagttggtttgaggagttcttctgaaaaagcttttgttccttttggcgttatagaatatacatttttatttggtttatcagtttgtgttatttgctctttagcaaccaaaccatctttttctaatttctttagtgttggataaatcataccaaatgtgccatcaaagaaatgattgattcgtgtttgtatcacttcgttgatttcatatcccgtacgtggtccgtcttgcaaaatacctaggacaatttctttccctttcatggtcatagctttttcctccgagtagttgctctttattattatacacatttgttacaccactaaggaattttgcatttttaaaatatgtcgttgctcctgcactactaaatattcattttttacttttcaaaaaaaatccaataatagccgataataatagaaacggtaatgatgccaaatagagattttcaaaggattttctcaactctatattagtattattttcaatgttttgtatactatgtttcaaaataattggcacatcattgatattagctttaacaaattttgttgtattcgtgtttgtattaattttattgattacattttcttgctctttatcaggcaagtgtagtttcataatttgatgatgtgcataagttttcgacgctgtttttgctactgacaaattactatacaggcccgttacaaatattgctactgcaagcattgatcctacttgtctcaagacacctgtcacactttgcgaggcagcaagaagttttccttctaaacttccagcagctattattagaattggtcctgtgataataccatatcccatgccgatagcaaatcctgccaaaattgtttgcatctgactcattaaagcaccaaatgcgagccacatatagccactagccatgacaataaagccaatcaaaattaaccatttagcattaacgcgtgcttgtgcaaaacccgatataggtgaaaaaataagaattgctagggaaattggggaaattaaaagcgatgaatgaaatgaatcaaatcctgcaatattagtgaagtaactaggtaaaattaccgttgttgctactagaaaaagattactgaaaataataactccggaggatactgaaaagttacggtcggaaaataattgtaatggcaccattgggtttttactacgatgttcaatccatacaaataatgaaaaactaacagcactagttagaaaacataaaacagtagcaaaagatgtccatgtccaaaccctgccctgcatcattcctaatgatactgtggcaagagtaaccatgattaatatcgcacccaaaatatccatggattgtttatgttgcacttcgttacgcatatttaaattagttataccgattaaaatcataataatcgtaagtggcacattaatccaaaaaatccatcgccaacccataaactgcgtaactatgccaccaattgttggtcccaaagctgctgctagcccttgcgtaatacccaatatggcaatcattccagtccgtttttcaacgttgactagcccaatacccaaagtcatggatagtgggaatacaatcgaggctcctacactttgaatggcacgaccaactaacaacatacttagttcagaagaaagagccgatagtgttgaaccaataccgaataggaaaacaccaattaaaaaacatttgtgaacccccaacatctcagaaatccttgttaagagtattgtgagtgatgcaaataaaattaaatacacatttaatgcccacgacaacgaatccaatccaacatctagatgttcgccaatatttggtaaactcacgttcaaaatggtagtgtccaacatacaaataaaaatcccaagtataaacagtatcgttaaaatcgttcttctcatcatataacctctgatcatttttatattaacaatgttaatatatactttgttaatataaatgtcaataaattattggtaatgtgaaggctttgcataatacttaccaaaaaacacactagtgaataatcactagtgtgtttttcataaagatatctgactattgccacatattttatttctcaagatatccttgtatcttattcatgtaattcttaacatttaatacttcctcattagttaaatgactgaataattgaactatttgtctatctgtctaggcattaatttgattcaatgctattattccatctttagtaatagtaagtgtattttttctattgtcacttacagatttcttttttcaaaaaaccattctttgtaaatttttcttgtatttcaaataaaacacgagcctctgttatggagtactcagtattagtggttttaccgtccaacgtacctataactattgcatagaaacgattaaactgtctgatttcatttataatttcttatccatggtatccacacttaaaaatgtggacatagtcagcattttattgtctatatttattagatatcatctataggagaattattatcatgattattagacctattaaaaaatccttaaaatcattgtacttttctattgaaggcattgcaccttttgataaaaaacaaaaaatatgcgagctccaaaaattatacttggccccagaagaacaagggttaggtatctcaaaacaactaatggagaccgcactttcttttgctaaaacatactatgacacttgttgtctaaaaaccaatcatactttcaaaactgctggtatttaaaagatttaaattagatatacataaagttttttgatatgtttttactaattaactctccaaactaatctcatatgttttctcaacaaagtctttaataaccgtcactaattcaactaccgagggagatactactttacttttaccagttaccaatacgatttgtctcgtataagactgatgaaatggataaatctccacatccccttgaattttttttaacgctaattttggcaaaataccaaacccaattcctgcctccaccattgaaataatagactggtcatcaatagaaaagttgattgaattaattgtaacgttgtaatcatctaaaactgactttgtatcacggtcataatctatcttttgtaatacaaatttttgattaataatatcttgctgcgtgatacttttcttgtttttaggcacaaaacctgctggtgtaacacaatgtattggatcctcaattaacggaatagttgttaaattgtctgtgactggtaatgtggtaaaaccaacatcaatttctcccgccttaacttttttactaatgtcctcaaaactgccttgaacaattgatacttcaatatcaggatactgtttagaaaacgaactaataattttcggcaaccaattaatacagacactactaaatgcaccaattttgattgatcctaaacgtaacccattaatatttttgctcatttgcaataaatctgtttcatcatctaatatttgttgaataaacggtaataccaactcaccatcatgagttaacgtcatgcccgaacggctacgtattagtagcggaaatcctaattgttcttcaagctgattaatggagtgacttactgcactcggtgtgacattaagtacttgagacgcttgataaaaggactgataacgaacaactgttgcaaaaacctgataagaaaatgttgacacaataactccttagaatactttttttcatgtaaaactgaaaaagattaattttatttattatacaagataatttactatagaacatagtgacttggaggaaaaatgtaatgagtcaacaacagaaattatcacgtaccctatctggacgtcatattaatatgattgcccttggagggacaattggaactgggcttttcttaggggctggtgattcgatccaaaaagctgggcccactattctattagtttatatcataactggctttttcgtattcttgatgatgcgtgcccttggagaactattattaactgatcatagtcagactgtttttattggatttatcaaaaaatatctaggtgagcacactggttttgtcatgggttggacctactggttgggttgggttattattgcaatggctgaattgacagcaattggtaagtatatgcaattctggtttccgaaaacacctgcctggttgtgggagctattgttcctagggattctttacagcatgaacattatcgctgttaaggcattcggagaaacagagttttggtttgccttaattaagattgttgctattgtggccatgattttaattggcgttgtcatggttgtttttcacatacgtagtgaagctgttgttacgaaattgtcaactttatggcagcacggtttaattgcaaatcatagaaataatttattagcagcttttcaaatggcattttttgcgttcttaggtgtcgaatttgttggtattacagctgctgaaacaaaaaatccattacaaactattccaaaatcaattaactctattattattcggattcttattttttatattggtgctttattggctatcatgacaatccaaccttggacaaactatagtgccaacacttcaccttttgtgcaagttttttctggtattggtattcctgcagcggctggtatcatcaattttgttattctgaccgcggctgcttcgtcactgaatagtgcgctgtttacaactggccgcatgattttttctttgtcacctaagaatagcttttttaataaactaaataaacactatattccaatgcgaggcatcacactatcagcggttttagtcgcttctgttattggattaaactatattttcccagaagatgcatttggaatagttacttcaactgcttcagctaccttcattgttatttacatctcgttacttttaacacatattaaatatcgaaaatcagaacagtttgctaatggtgaaaaattgttcttaatgcctggtgccccctactcaaattatttaactattttgtttatggctactgttttcttgatcttattgttttcacccaacacaatgataacaacaatattagcagtcgtctggtttatcgttctctttacgattagtctgtataaaatcaaaaaataacactaaaaaaaggaagacatatcttccttttttaattacttcagttgtttcaacccaataccagttagcgcagaagcaattgacatcacaggcgacaacaatgcaaacagcgtgaatggtgcgaaagctaataccgatacacctagtgtttgcgctgcaaaggcaccagcgacaccccacggtactaagtaatttgttactgtaccactatcttcaattgttcttcccaacgccagcccagataagttcacacgtgtaaagctatctttaaataactgcccaggtaaaatagtcgctagatattgttccccaaccaaaaagttggcgccaatacctgttaatagcgttgctaaaactactgatccttgggattgcaaatgtcctacaacaggtgccattacagctttcaatatacccaaaccatctaatagaccaccaagcgctaaggctaacataatcatcattacggtatccatcattgaagacataccgccacgattcagtaaaagaattaaggtaggattgttacttgtcgtcttgaaaccatgaactaataagtcagaaaaatcagatacactgtgttgtgctaaaaaagccacactggaaaccaaaatgttaatcattaaggccgcaatagctgggattttaaaccaagcggtgactaccagcacagagagtggcacaatagcccaccatgttggttgcaataatggtaataatgaagcaattttttgtgttgttcccgcacccgaacggtggccgagaccaagcataattgtcacaagaaatgttatcccgaaagcaggtaatgttgtccacattaaatttttgatatgcgcaaataaatccgtctctgaaatggcacttgctaggttagttgaatcagacaagggagaacttttgtccccaaaaatagcgccagaaaggatagttccagcgaccaacgctggatttaagcccattaacgttcctacacccattaacgccacacccacagttgataacgttgtaaacgcactaccaattaacgttcctactatggcggaagttaacaaagcagttggtaaaaagaactggggatttagcattttaaatccaacccaaaccatcgtagggattacaccggtagcaagccaaagtgctatcagggcgcctattagtaaaaataaaaacaacggtgctatacctgaagtgattcccttaatcaaagctgcttgactttcttgccaactcacacctcgtaaccgagcgactaggacaatcatactaatcactagcaaaatcggcacactcggcgatagtccaaagccaataacagcagtagctaaaataataattacaacaatcaacaatgtcgtcgataacttggtagttagtttgttttccatgtttatctcccgcgaataagaactatatttctgcaataaaaaacgtccctgctgttataaaacagaagggacgaatcgacatttacagaaatccgtggtaccacccagcttacgcgtcaaaaacgcatcactttaacatttgataacatggtgttgccacgcttaaatattaatagctgtatttcagataacgacacctgcgcagttttcaccaaccactgcttctcttcaccccgaatgtcaatcttacttagtatttatgctattcacagaaatttcattctactatgaaaatctttttctgtcaacttaatctcatatgttacaaaattttctcaaatccatgtacaaaaatgcttatttattaataagttcaagaccatattctgctaacaattttttgtcagaaacactatttaatgaaattcctttcgctctaaaggaatctaacaaagttgttgtaatttttttactgtccaatagatcttcgtgttttgtgttggtaaacttgtacagggcatcagtatcaactattctgaagacatgctctttgctttcataaatcaccgttatatattgttgtaaccattcacttttattcttaatcataattgaagcccacccttcttaaccacattgtacacctagcaaagaaactttatctagaaaagacatgtgtctgcttaaatgagttcaatataattaaccaagtttcttattgtgactaatttaactttattagtacagtcgagtctattagcttagcttcttttctaacccttccattggtgctaatgcgttttggtagtcgctttgcgtttcgatgtcatcagtaaaatgcatgacagaataaaaggactctcttaaataaacttgcatgacagatggaatagccaattctgccatatcggacggactaatcaaagttcgaatactttccaaatcgtttctttcaatcttttgaacccattgcggctctctaatgaattctcgaccaatagctactaaatctgcaccatcagacatgacagcattaacatcatctggtgtttccactgatcctataccaataagcggtactatattcttcgtatgttgagaaaactgagaaattaacgtttccttgttcgccttattgtttagagatgtccgtttataactgcccatagatagatggatatagtctactttgtgcttaatctgatcaacgaagaagagagaatcttctaatcgaataccgggctcctcaatttcttctggggagattcgataaccgactatgaatggtttttttgaatatttttttaccgttttattaacagtttcaatcacagctaatgggaactttaggcgctttcctctagaaccaccccactcatcacttctttgattggaattttcagaataaaattgttgcaacaaataagtgttggcgccgtgtagctcgacgccatcaaaacctgcttcaatcgctcgcctagttgcttcgccaaattcagtaataatttggtgaacttctgaatcgtttaatgcccgtggagtctcagaatcagctggataactagcagcaatcgcactagcactaacagggcgttccccacgaaggatagcactattggcttttcgacctgcatgaaatatttgcaaaattgctttggtaccgtctttatgaataaccttagctaatttagttaatcctggtagcattgcgtcatgagcaactgataattcgccttcaaaccctttaccattatcactaacattagcaacaccagtgatgataatccccgggcctccagcacgagctgcgtaataattaagttcatcggtggttatcatgccattataaaaactagtcattgttgtcataggtgacatcacaatatgatttttaattactaagccgttatcaaatttaaaacgagacaaaaactttcgtttttccattgtattatcctttcggtcaattgtttcttattcctgtacatgtagtatactgtttacagatattgaaacaagtacgcactaatatgtaccataggaactaaaaggtactcgtagaatatataaggagtcacgtaattactgatggaaaaaatatatcatatcggtgtagaagcaactttagatgtgattggtggcaaatggaaaccaatcatattatgtcatctaggcaatggccctattcgtactggcgagctccgccgtcgaatacctaatatcgcccagaaaacgttgacacaacagctacgcgaattagaagaagatgaaattattatacgcaaagtctataatcaagtgccaccaaaagtagaatattacctatctgaggaaggtaagactttgcgagaagtattaatagcaatgtctatttggggtgaaaaacgagtcagaaaattgcaaagtaatatgcaaccagtcaatttattgaataataatcacaatggctatttgaaattcgatgattaatattaaacctttctcgctaattatctggcatgtgattaaaactattatcatcaaattcatttatatagtcaatattttatgctccacttattttatatttaccaataacattgtcagtggccattttgattcaaaaaactaatataacaaatttaaagcattataaacctgctgaaatacggttcaaccgttcaatgtcgctgttagacaaatcgaaattcaaagcctctacgttatcttgtgcctgttgtattttagatgctcctgggatcgctaaaactgtatccccttgagcattaattaaccagtttaaagaaatctgagaaattgtcataccatagtttagtgataacctctttagttcttgataaagtggttcagtcctttgcaaggttttagtagtcagattcgactgtagctttctaaaacgactcacctttgataaagattcaggttgttcatgaaagcgccctgttaataatccttgttgcaaaggcgagtaagcaattattgttatccctaattctttagcagcctctagtgtgccatttttctcaggactacggtgtagtaaattatatttaacttgattggaagcaagtgtcatcccatactcttgcagtaaatgatgggctttgaccatttgtttagcagaaaagttgctcaccccaatctgtttcactttgtgttgttctgcaagcgacaccatggcttcaatctgctttcttaaagatgaccgagatgtcggttgatgaatttgatataaatcaatggtcggtacttgtaggtattctaaacggtcatcaatcgttttagtgattgatgacgccgaacgagccaaaggaaaccatttactcgcgatgaaaggattggttgctaaggcttcttctctttgcaagcgctgcgttacttccccaataaatgtttcagaggttccattgccataaatttcagctgtgtctatccaattcatcccattctgtaaggaatgcttgataatttcataaactgtctccgtctcggtatttccccacattgaggttccgctgctattttttgtactatattgccaggtacctagtcccagtggagataaatacaggtcagtccgtcctaattgtctacttttattcatggttattttatttccttttttattttcaatcgtacgatgtttgtgtagtatgctattatagataaaaatacttttactataggatgaagaaaatgaatgatgctgatttattaagatatcttatcaatgctgtccaaaaagaaggacagaaaaaatatgctgagttcttagctcctcttggtataacacctaatcaaagtgaggtgttacaagttttgtcaaaaaaagaacctctatcattaaaagaattaggtaatctactaatttgtgaaagtaagagtcctagtcgattagtgcaacgattggtgcaaaatggtttcatctataaaagtaaagccattgatgataatcgaaaatcagtcctacatttgacctctaagggccgtgagttaatacctagtatcaaggagaaagaaaacctatttaatgcatataatctctcctctctatctgacacgattgatattaaaacctttatttctgttttgagataccaaataactggtacagagagtgaacaaaaaattgaaaaaagaatgaaaatagattcatcattaacttgatgaatctattttacttttccaattcgtccattaacatactaggataacgactaccatgtgtattagattcatcaaatgttttatctaaaatatgaattattttatcatcaagatcaatatgacttgatgcaatattttcgttaatatgctgaattgacttacttcctgggatagctattaagttactgttcttttgcaataaccatgccaaggctagttgtgaagatgtcattcctaacttttgtgataaattacgaattactttaaatacttcctgattagcagtgagattgtcaccctgaaacctaggcaaatattggcgtacgtcttctttcgacgcatccaaactaaagtcatctgcaaaaaatcctctgcccaatggactgtatgctacaaatccaatttcatttgcttgtaaataaggcattatttctttctcaacaccacgactccacaatgaatattcgctttgaaccgccgttataggatgtgtttgatgagctcttttaatcgttgacaaagaggcttctgatatcccaatgtatttaactttaccctcttcaactagtcgagacatttcaccaatgctttcttcaattggtacatctgggtctactcgatgcaggtagtacaaatcaatatactctctatctaaacgaatcaaagacttttcaacttcagatctaatataatcaggacgaccgttgactctcttttggttcaattgcatttcttgaatgcccacttttgtggccactgtcacttgcttgtccacgcctttaagtgcttttcctaataatttttcattatgtccgttaccataaacatttgcagtatcaaacaatgaaatgccattaacgaccgcctgcctaattgacgcaattgattccttgtcatcagcgcgaccgtacgtgctactcatacccatgcaccccaacccgactgatgaaacttttaacccttgcgaccctaaatttctttgtagcattttcttttcctttttttgtaataatttgataaatacatgatacatcatctattgtttataaacaacatataattaataaaatttatagttttatataaataaaatgactagtcatttttaactacaaaaaatgtcgactatattcataatatataaaaagagtgcaaagtacctgcactcataaaaacagtttattagacacctatctaccaaccacaacaaaaaacagcctgctctcaggtgacaaacataagacccatacatcttatgcgtcaccatcgaccctaattaccagccacatgtacgttttcacacgtccatcactttccaactagagtactgagcaaactgtcctggattgaagaaaatccgcttaagctatcattcgtatagcttacacaacttgaattgttttaggactctctcctaatctatacttaaattataacatggtttttgcttgtctgcaagcgcttacacgaaaaatatttgtctgttcggtataattaaaaagagcaacatttttacaaaggagaaaaagtaatgaaaaaaatagatgcctttttgatcatcgcaaaggaattgaataaggtagcaattactcctgtcctgatgggttctgttggtctagaatatttaacaaaaatagattggcaggctaatgatatagacattcatgtacccggaaatcctaacggttgggatgcaccagaccgtctaagaatctaccaatgggacttgattctaaacatcatgcttggtttgggttttcaactaacgaatttgcatgaacatgaattccaaaaaggggatttatcagtggcatttggtagtatagattgtttaccacaattcgcaaatgttgatttacaggatttagttgaaaataacctcggcagtattaaatttctgacgcccactttacaacaatttatgaatatttatacagcatcttcaatggacagttaccgccaacaacagggcaaccaaaaagatttatccaaaattgtctttcttaagaaacaactttcactgaaaaaggagaataacaaatagtttatttgttattctccactgtttttttagttcgtttcgccattgtgatcgctaacaaagctgtgataattaacatgattataaatactgataaaaaaagaattttcatccaacctcgatccatcatcatacccgaataaatgggaccaatgactcgacctgagctgatcatcattgaaacaaaaccttgtgcctgtccagctacttctttgggggtgatttgcgcaacccatgctggaacctgcggactttgtaacatttctccaatcgttagtaattcaaacactagcacaatttgccaaaactcttttacaaatattaaaaagaaaaagctagaagcaaaaataatactacctaaaataactgaaacttgatatggtcgctgatttgcccaattagaaacaaacttctgaagcaaaataatagttacgccgttaatcatccataagtctgcataattacgcgttggcatacctaaacttttcatgtgcggtgccatcacggtttcccacagcatgtaggataaatacgtaatgaacagcaatgccccaatggcaactaaaactggcgtcaagcgaaaacgttgatttggtgcaccgacactgctcactttttctgttccttcaggcgtcgtaacgcccgttgcttcagtattcgtgcgaactaccggaacattaaatttggttgcaataattaacattaatgtaaaatataatgctgccgaaatcatcatcaacaggttaaaaccgtaatcaaataaatatcctacggctaaggttcccaaaaccaccccaatattcaacacaatgtacatattattgaatacgatgcgcgttttttcaccaggaattgttgtggcaaaagagttaactaacgtttgttccgcgcccataccaaaattagctagccaaataaaaaaggcaaatacgggccacccattccaaataattagactggaaacagcaattaagatgataaaactcgtaattaccatcgcttcatatggccgccaattatcaaatagtttgccaccaacaaatgagccaaccatactaataagtgatcccaccattaaaactagtcccgccatcgtaaaactttggtgcaaaacaccggtcatataaagtgtcgtgactggccaaatcattgaatttccagtgttagataataaagtaccaaaaagtagccacttttcatcaagtggccgcggcttatcagttaagtcaatttgcataaatcctccgaataatagaataattgtaacacgaaacctattcatataacggaaaattaagtgcttaatttatcatcatttgcgcatatcccgtttgttttttattaatcgaaggatgacatatataatacccattaaaattagaccctcgaacgccacaccaatacctaaagtgaaagttagaattaaaaataaaataataatcaagtaaaacatttagcaccatcccgttgtaaaattatattgtgaatatatagtttatttaacatactcaaaccatacttttagtataaactagtcatttaatcaatttttgacttgttcaacgcttaatatgtttgtgaatcccgtacttttccagacctttttgcgttataatggagagtgaatttaattataatataaggggaacatcatggtttcagaaatcaaaacgttggtaactttctttggcggaactggtgatttagcaaagcgtaagctttacccatcagttttcaacctctacaaaaaaggatacttacaagaacactttgccattgttgggacagcacgtcaacaattaagtgatgacgagtttaagcaattggttcgtgattcaattaaagactttactgaagatcaagcacaagctgaagcgtttattgcgcatttttcttaccgtgcgcacgatgtcacagatgccgcttcttatggtatcttgaagtcagcgatcgaagaagcagcaaccaaatttgacattgatggcaatcgtattttctatatgtcagttgcccctcgtttcttcggtacaatcgctaaatatttgaaatcagaaggtttgctagctgaaactggctacaatcgtttgatgattgaaaagccttttggtacatcatacgccaccgcagaagaattgcaaagtgatttggaaaatgcatttgatgatgaccaactgttccgtattgaccactatcttggaaaagaaatggtacaaaatattgcagcattacgttttggtaacccaatctttgatgccgcttggaataaggactatatcaaaaacgtacaagtaactttggctgaagttctaggtgttgaagagcgtgctggttactacgataccactggcgcccttttggatatgattcaaaaccacacaatgcaaattgttggttggttagcaatggaaaaacctgaatcattcaatgataaggatatccgtgcagctaaaaacgccgccttcaatgcactaaagatttataacgaagaagaagtgaataagtacttcgttcgtgcacaatatggtgctggtgatacagctgattacaaaccatatttggaagaagcagatgtccctgctgactcaaagaacaacacattcattgctggtgaattgcagttcgatttgccacgttgggaaggtgttcctttctatgttcgttcaggtaagcgtttggctgccaagcaaacacgtgttgatattgtatttaaggctggcacattcaactttggttcagaacaagaagcacaagaatcagtactctcaatcatcattgatccaaagggtgctattgaattgaagcttaacgctaagtcagttgaagatgccttcaacacccgcacaatcaacttggattgggcagtatctgatgaagacaagaagaacacaccagaaccatacgaacgtatgattcacgatacaatgaatggtgacggatcaaactttgctgattggaacggtgtatcaattgcttggaagtttgttgacgcaattactgccgtttacgatgcagataaagcaccattggagacatataagtcaggttcaatgggtcctgaagcatcagacaagctattagctgaaaatggcgatgcttgggtatttaaaggataagcacatttaaaaagaccatcaaacaaatctttgtttgacggtctttttatattgtctgatttaagatgcgtttggtttcacggaaaacggctgacaaattggtgtattgatcagcatgcaatacaaccgtgatataatgcttccctttatatgtaaataatcccacataagaaacacctgatttaacagagataccaagtttaacaccggtgaccgtatatttcgtatttttaaaataatttttcattaaaacataattactatcttgtgtaatgccatcaaattgattttgtgattgatgaacaattctctttattcgtggtattttttctaaaatattatcagtcataagcgcaacatcaacagcagacatcttattttctgcattatcaggcgccttgacgccatcatccattgcttcatcattacggattcctgctgcattataccattgcgctgatgcaagcccccaagactgactagtcttagtcattaatttaacaaactttgtttgtgaaccactaacctgatcacctaaggcaatagccgcgtcattagctgataactgtaaggcagcacgcaataattcatctgctgaataggattgattactatccaaattcacacttgccagattagattcttctccgattttcatcgtgtttgacgacggctgcacttgcgtgcctaaaggtaacttttttagtaccaaatagcccgtcattaatttactaattgacgcaatcgctaaaggtttatgagcgtttttttcggacaaaattttatctgtatccgcattcatcaccaccgctgctttcgccgttgttgtgatttttttaattgatttcttttttttacttgcttggatttgttgcccattcacaggaaatgctatactcaatgtcacaatacaaattgctgccagtagtccgcttttcttcatgactataattgtactcaaaaataacctgttgacaatagcttcgcttacattatataattaactggttaattaaccagtaaactaaagaggtgtttatggaaaaaacagataagattattcaagagcttaactcttttgttcaagaatacgctactaattctgaactcgtagcggcaactgctggacaaaagatcaattcaacacaagcccacttactaatgttgcttaaaattctgcaatcgcagactaacacagaattagctgctgcaatgaatctatcaaagcctgctatcaccaaagctattaaaaacctgatgcgctatcattatgtcacagcggtggtagatgattctgataaacggagcactcactatttactgactgaagatggcgaaaaattggcacaactccacgagcaggcccacgccacgatgcacgatgatattcataccatcatggctgatttcacacaggaacaacaacaaaccatcacccagtttttaacaaaactcaataaaataggaaataactcatgaaaaaaataattatagcactctctgccattgtcgtcatcgtcattggtgttgccttattcagaggtaactcctcgtcgtcatccaatcaaaaaataactattgttgcttcaacagacttctacgccgaaatcgccaaaacagtagttggcgaacacggtacagcaactgctattatcaaggacgcgaatgtttctcccgaagattatgagccaacaaccacggttgctaaaaaggttagtggtgctgatatcgttcttgctaatggtctaggatatgacgcatggctaaataagcttgccaaaacttctaaaaatacaaaacttattcgcgtcggcgaagatgttttaaataaaaaaacaggcgtcaacccgcacttgtggaatgatcctgaaacgatgagtaaaacagcaaattacctagcaactgagcttggtaagaaagaccctaaaaaccgcgattattacaaaaagaacgccaaaaagtacgtcgctagcctgaaacctgtgaatgatttaatcacaaaaatatccaaaaaggctgatggccaaaccgttgcccaaactgaacctgtttttgagtatatgctagatgccttaggatacaaaataatggatacagatttctctgaagcaattgaggaaggtaatgatccttcacccgcaacattagctgcacttaaatcagcaattacaaaccataaaattgccttcttcgttaataatactcagacatcaagttcaactgtctctaacttaatcgatttagcaaagaaaaatgacatccccgttgttaatgtaactgaaaccattccaaacggtgaaaactatgttagttggaagctaaaagaactgaaagcaatcgaaaaagttacgcaataaaaacctctctgaaaaaaattaaaaagatcagctatccaaatcataaagatagctgatctttttagcattaatttgcctaccaatgaaatactttatatctaaccctattttgtcgcatagtgtgccgccgcggcacccaaattaaaacgagaaattctaacttttttgaagcccgactttagcagcaattgcccaagcgtcatatagtccataaaatgttctgttgtttcatcaagatatttgtattcctgatattttcctttagcaaaaacacgcccaaataatggcatgacatgaccaaaatataactgccaaaatggtttaacaagggggctatcgggttgcgatgtttctaaaatgacaagctgtccgcctggctttaaaatacgatacatttctttgattccttgctttggatcaggtaaattacgtaatccaaaaccaatggtcacaatatcaaagctgttatcaggaaattctaaatccatcacatctccttgctcaagtgtgattttttccgaatagtcacttatatcaatctttgtttgcccgaccgcaagcatggattcactgaagtctaggccaatgatctcagaatcagagtcactgttttctgccaatgcaattgcccaatcagcagttcccgtcgccaaatcaattatttgtgctttttctggaaatatcatcttatccataaccttctgacgccactttttgtgcgatcccaggctgataatgttattcattttgtcatattctggtgcaatagtattaaacagggatttcacatctgtattttttggagataatgtcatatcaattcctttaatctttcaagttcagctaggaaaggtttacgttgtgtttttccactagcagtagtgtgccagctttgagccagataaaatcgttttggtattttataatgcgcaatacgctctcgaccgaattgaattaaagcatcttttttcaattcttcacccaaaacgatagctattggcactgaaccccacttttgatccgacaccccgacgacgactattttatttaatcctgggtattctgcgtaaatatcttcaacttcattgggaaaaatattctcaccacctgaatttatcatatcaccttcacgcccttggacaaacaaatatccttcagcatccaaataaccataatcttcagtattaaaccaaccatctatcatatgttcagctagtttatctggttgattgagatatcctgtcgttagcgttggtgattgaatccaaatattcccttgctgggacacttttccagcatgatcagcaatttttaaacgaactggaaataatggtttccccacagaacccactttttgaaccgcatcttttgcatcaagcgccacaatttgcgaggcagtctctgtcatgccatacgattgaatgacaggaatttggtggatctgtgcctgtttcaatgttgcaaggtctgttggtccaccgccaagaagcattgaccgaaaatgattattataatgagcaccttttggtaggtcagcaactaactgttttaacatcactggaacgactgatatagcagtaatcgattgttcaatcaacagttcattaacctgatgagcatcaaatttagattgtaagaccacgcgcataccataaattaatccacgcataatgatcgaaaatccactaatgtggaagataggtacaacagccaaccaactatcatcagatgttaatcctaaattcaaagcactccccatcgcagaatagaaatggttttgatatgtttgcataacacccttggctttactcgttgtacccgaagtatacatgatacttgtcacaaagtcttcaggaaaaatttcaattggtattatcttttgctgtgtggacaaatcactgaacttaatttgcttatcaatacttagctcgctcatgtaatcatcatctgttaaaacagttgtcacacccgcatctgcaagctgataattaatttctgctactgataaacgccagtttataaaaacgatggtcttgccaagttgctgcaaagccataatcaccaagtatcccgtgagcgtattattcattatcaatgccacgcgagaattatcttgggtaactgtcgcaatttttttggccatattgtgtgcttggtcagccacttcttgaaatgttaattgtttatttttatactgtacggcgatccgattcggcgtaagccgtgcacgttttgtaagccagttttccatttttatatcataccgcagaatttctttgaaaacaaaaatgttgctgtgtcaaaaatattagttttatgactaaaattactcaacctgggcttcaattcctaattctgagactgcgttgagatagtcatcgtcagagatttcatctgtcgtacgcaatagatggaaagtcccgcccatatttttagtcacgagatgcgcatcgttaaccccattgcgcttataaaaatcatatcgtttcacacgttgcatttcattatctgcctgttggcctgtaatttctgattctaatattaccccatttgggtactgctcttttaatgcagcaattgttttactcccaatccctcttccacgaatattcgcatcaactgcaaaatagagtacaaatactttttgtgctgatatttcaaccaataacaaaataccaactggttgttcatcaacaactaaagccatcttaacgggttcttttgtcttagccagctgagctagctgcataaaatcaaggcgttcatattctggaaatgattgcatataaatgtcttgccaataagctttatcttcttcggttacgttaacaatttttatcattagaatgatctccatgtacatagtagcgattgttctcattttatcataattcaaagaaagataggtctacgctatttaaaataaaaaacgcaccaagcgtatcaacttaaagtaacacttttttgatctgccttagcgtattttttatgatgatggttcaaattatttgttctttatcagctaatttaaacacgtgccaaatagtaatcgcaacgacccatgcgataacaaacaatgcgaccagtatgacgcccatctggttaaaatctagcgaagccgcccatcgtgtcaatgcgttgttccaattaaacatcacgctaaatgactgaacaaaatcaataaatccaataaatccggctgccattatagaaatccctgtaattgttaaattgtaatacactttacgataaggtgatgaaaatacccaacgatacgtcgtactcataaaaaaaccatcaatggtatccatcaaacacataccagcagtaaataataacggaaaagctaatgttgcataccagggaactcctgcatttgcagctgtggcagatgttgctaatactgcaatctgagtagcagtatcaaaacctaatccgaaaagaaatccaacaattgctacttgccagttatgcttaatcattcctaatagtttcaaaaataaacgataaatcttagatgaattgatttggtcatctgtacctgctttggtatgatgattacgcatagcgacaaacttcacccagatatcatgcaagataacactattcacgatggccaacatcatcaacatggtagctgcaataagtgttcctaaggcgcctcctatttgctcaaaaataggcatagaatgttttgcccattctacaaacagaacggttaccaatgccatcaacaccacaaccattgaatgtccaaatgaaaaactaaaaccaacgccgcgtgtatttttaccatcattaagcatcttgcgtgtcatgttgtcaattgctgcaatatgatccacatcaaaagcatgccgcaatcccattgtgaaggaaagataggccatcgctatcatttcaggatattgtgtagcacttgtcattaacaacagcattcccgataccaaaaaaagaataattattgccccatagcgtatcgcatcggactgaacagttgcttgtttttttatatttaacatcataaattttctccctttttgctgtagaaataagattatcacagcacctgttattgcgtaaatatgctgaacaaattgtgtccctaatgaactaaacatgtccttccatactacattcgattattttttagcacgatgctcattcgaattcgcgctactacctctttaagttgaaaaggacaaaaaaacaccccaacctttaacagttggggtgtttttactcacttgtcccaactatctactaatcaatgtcacattggtttagtagatagtcactcaaagaacctactaaacatcaactgagaagtaggtagaggagagaatggttcatttttttaattgttttgttcataatttttcctctttttcatataatttatattttttaatatgaaactaattatattatcttactctaattaagtcgaatgttttattatcttattttaataatataactaatgatactaaccagctactgagcaaatgtattaactactgcttaatcgtcacatcgccgctatctgttgatattacgtatgctccagttgttcctttatgtgtgtaacttgtctgatcatcatcatgactattgaaagcagaaatatccccgtcaagcgttttagcagtcacactacttttcccaatcattgccgatatatcgccatcttgtgctgtaatggtaagctgaccagatagttggttattcattaaagcgacatccccatatgatgtgtttattttacccgtattaatatgattatgatgcatgctcaagtcaccattttcaagttgaatgttcattccatcgctaattcgtgtattttgtatagttaaatcaccattatcacttttaattgtagctgtcgatgtagtcacgtcatttaaatcagtatcttcaatatcatcgaacgttaagtcatgttgaactattatgttttttaatcttgtatctgcaacatgttgaattgctattttatccgctttgacatcagacaggctaacatcactgctattctgtccgtcaatttgaatatcagtcaaactttgtgattgcggtactgtaatcacaataccctcttgatatccatggttaccgtaattccaagaaatgccagtaatattaaattcgatgttaatattaccttgagatatactgttagcctgtttatcagtaattttcaaatgactttgctgatagctcaactcgggtagtttttgatacgtcattactttaacggtggttttcttaacatcccctgtgataatacgtacaggtaaagatgttgacacgtcaatatttttcacctcgctataagtatatgaatgttgtaccattctttctttttgtgttttacggtcaataactttagggccattattccaagaaatagaactggatccgccaccaaaaccaaatccaattaaagctagcacagcaccaataactatcaaactcaatccaattttaacacttcgtttcatgttatttgtcctcccgatgcatgtgctttttatcagtaaagcgacgataaattgccttgcttaattgtgctgttttatcaattagccacctcaagagaccaataccagctggtattactgtcaacattatgcccaatatgagcaaaccacaaccaatataatacagccccgtccagattgattgcagcaaaacgccaactccgataatgactaataaaatacttgtcaggctcagtgcaatgacaactgcaataaaagccgctaggactgcaaaaccaacagcagcaagcgtgaccaagacaatgaatacaggtaatgctaacggtgacgccagtaatgctaatccaatccaccaaatcagcttaatatttgaccgtggatttttactagtggtatcatctgttgatttttcatctgccttaattgaatagtcagctaaaatttttcgtgagagttgttttggtgtgcctaactcactaatgcattgctcatatgtgactaaatcagcatccatcacgtactctcgatagaaattcatcgcttcctctttatctgaatggtgcaactgatgtagtagttgctctaactcagctaaataattctccatctgcttatctctccttcaataatgtgtcaacgtttgcttggaacattacccaatcttggcgtatgctagccaatctgtcacgacctcgtgttgtaatctggtagtaacgtcgatttctgccttgataaggttgatcatacgttgtaacaaattgattattttttaatctccgtagtacagggtataacgtcgattccgaaacagaaatcgtgccctgcactctttgcgttaatgcataaccgtaataatcttctttatctaatatcgctaaaacgcaaccgtctaataattctgaactcatttgaattgccatacttattttctccaatactatacgacatataatatatgttcaaaaatattatatggatttttaattgttttgtcaacaaaaaaatatctcaacaaatgtcattgttgagatatttttcgttgcctaatcatcttttaatagctcgcaatcaataaaatagatagcgtaacgctcgtttggcttttaactgttttatgcaattttttagtaataaaatccgtgacgatagtcccatgacgagaaaatatcactcataattttcatgattttgtcgacatctaatcctttacgaataacgattggcgctggttggataccaacagcaccattttgttctggaatgagcttacctgtctcatcaaccatagataccatcaccccttgttcgtaacgtgtatctaatgtcttgtcgggttgaattgatgccacgtaatcatcggcctcaataattaagtcagcagcattttcaatttggtcaccaataccagctaccaaaccacgattccccttaccagaaggattagctgaacttgcaaatgagaacttaccgtacttttcccacatttctttggcaatattttcacttggtgtaccaaacttgataacaaaacaactagtttcacgtttatccatcatcaaatttttggtcccgtcatttggtatcttgctctttgcttcttctttccatggcaagatacaacccaacaaaatgtcctcatcccaatgttgttgatacatttgttcgatttcaggtgtcatttgtgctaattctttaacttgttctactgaaccacatagtacgacacctggtttattacgcttacgattcttagcagcaaattttcgttccaacccttgatcatctgaagtcatgataatgtaacccacttttgttggactaacgatcatccccccatcttctttcaagatgtcaatggcttcaccttgaacgccaccattccaatgaatctttgctgttgttgcttctgtcatgataaaataccatccttttaatatattgctttttgttttgtttctggcccataaactgcgaccacaatagctgcaattagcgccactgctgcgataaaatagaaaatcaagttcgcactaaattgtgtaattgcccacgctgcaaaatatggtgttaaaaccgtcaatattttagcaacgccattagcataacctgttccacggaatctaaagtaagtggggaacaactctgacatataaaccccgacaaccgaagccatcaaaatatacatcatagttacgaccaaaaatcctaccgttaaaattccaaccgttgtatgttgctgcgaataaatcatcccaaacaccgcagtcattacaaaggcagaaacaatgacctttttacgacctatcacgtcaaccaataatgcgcctataagtgcgcctattggagccccagccatcataactgcggagaatgttagtgaatgaaccacttcgattccttgtttgatcaataatgttggcatccacgatgtaaatgtatactgtgttaaattaactgcactgacagcaaccgttgcaaccaaaagcccaataccaatcctagtcttcactggtagtcgttttacactagaatcatttgtgctgtacgaaccattcacttccaatttctcaatgatcttttcagctttatcatattctccgcgtgcaattaaccatcgcggtgattcgggaaaatgacggcgaaccacccataaaatcaatgctaacacaccaacaataacaaacattgcacgccatgtataacgaggaataacgcttgctgccaaaagtaaggtcaatggtgcagccaaattagcaatcacagaagttacgccactccaccgaccacgatttttaattggggcaaattcattaattagggcataacctgtcacaatttctgcgcctaacccaattgcggcgaaaaaacgtagtccgactaacatccaaatattagttgcaaatgccgcacatagggttagtacaccaaatatcaacaaattagtcgaatacgcttttcttctgcccagaaaatcaccgataaatccagcaaaaatggacccaaagaaaagacctaaaaatccagaggaaagaaacacagaaccttgtgcaagtgtggcaaaatgtgtgctaactattgcactatttactgcactagcaagataaacgtccgccccatctaaaatcataccagctgcaatcatcgcaaagacacggtaaaatgtcgctgtttctttggtcgtgtccatccgttgttgcaaattcattgcctgttccatgtactgcctcctaaccaaaatttggtcgttgcttttcgaatgcagcgatcaatttttcatatttcatcgtgttatcaatatcatcttcaccattgataaacttttctttccattgtgagttgatatcaaagtggaaagtatagtttttataagtcacagtttgttcgggtaaatcaatttgaatattttcatctgcttgaataccccgtaatattttccgattttcttcgggcaacacaatcggtaacaaaccattcttagttgaattcatgtaaaaaatgtctgaaaatccgccgccaatcactgccctgaatccataatccgttaacgcccatactgcgtgttctcgtgatgagcccgatccaaaatcatttcctgtaattaaaattgaagccccttgatgtgctggtttgttcaactcaaacgcctcattcaacgaaccgtcggcattgtagcgccaatcaaagaataaatctttaccaaagccggtctttaaaatgtttttcaaaaattgtttaggcaagataatatcagtattaatgttgtcatttggaataacaaccgctctacctgtttctcttacaaaagcttccatattattcccctatacaaattcatctgtcgtaatatcaacgaagtgaccagcaatccctgctgcagcaaccatagctggagaagccaaatgcgttctcgatcctgcaccttggcgtccaatgaaatttctatttgatgttgaagcaacatgtttccctgctggaattttatcgggattcatcgccaagcatgccgaacatcctggttcacgccattcacaaccagcttcttcaaatatttgagcaatacccgatttaatcgcacgatttcttatcgcacgactgccaggcaccacccaggcagtgacattaggcgccaagtgatgccccttcatcatattcgcagcaatttcaagatcttcataacgactattcgtgcatgatccgatgaaaatgtaatctaaattaatgtcaactggcttcatattgggatgcaagccaatatattcataggcattggcatcattatcatctttgattgctggcaaagactgatcaacaggtgtggccatgcctggatttgttccccatgtcaccatcggtttcaaatttgatacatcaaaggtcaacgtctcatcaaaatcactttcatcatctgtgtagaattgtgaccaatagtttttagcggattcaaaatcttttggtgcttgttcacgaccttcaatgtagtcaaatgtcgtttgatctggttgcaccataccagttcttgaaccagcttcaattgacatattacacatcgtcatacgagcctccattgaaaggttctcaacagtttctccgtaaaattcgatcgcataaccgactccaaacgacaccccatatttagcaatgatgcccatgataatatctttggcgtatgtatttttaggcagttttccagtcaccttaatccccatggtttttggtttaacttgccaaatcgtttgggtcgctagcacatgctcaacttcggaagtgccaatgccaaaggcgattgctccaaacgcaccatgtgttgctgtgtgggaatcaccacagacgattactttggcaggctgtgtcagaccccgttcaggccccacaacatgcacaattccttgcttgtcatcaccaattgatgctaatgggatgtcaaattccttcgtgtttttgaccaatgtatccatctgcaatcgagacatttgatcttgtacattaaaaatatctttagtcggcacgttatgatccattgtcgcaaaggttaaatccggtcgcctaacgcggcgatttgtacttctcaacccatcgaaaggctgtggtgaggtgacctcatgtactaaatgtaaatccacataaatcagttgagcttcaccgacttccccagtaatgacgtgtttttcccaaattttgtcaaatagtgttttgctcattttatatccgccgattcatactttttaatgtaatcaaccattttttgcgtgacctcatcggtcgtcatcgcgccacccatgtctggtgtcacatagtggttttcaataatgtagtctactgctgcagtaattttatcggcaatccttttttcatcaaaactttccgttaacatcatagctaccgtatttaccatagaaatgggattggctatgccttgcccagcaatgtcaggtgctgagccatgaattggctcatacaaattagggccgctttcaccaactgacatagaaggtatttgtccaattgagcctgtaatttgtgctgcttcatcacttaaaatgtccccaaacaaattaggtataatcacaacatcaaatgctgtgggcttggccataatagccattgtcatcgcgtcaacatagtaatagtcgattgtcacatccggataacttttgccaacttcattagcaatctttcgccaaaactttgatgtagccaatacatttgacttatcaacaatggtgacatgcttgttccgtttttgcgccattttaaagccttggtgcataatacgagttacttcttcttcactgtaatacatcgtatcaatcgcttgatgtgcttcgagcttacgtggctttccaaaataagcaccagaggtcagctcacgaacgattacaaaatccgtattttcaacatactctggcttcagtggtgaacggtcaatttgtgctgccgtcacttttgttggccggatattagcaaatacgttaagttttgatctaatttctaatagcccttgttctggacgtcgtggcgcattatcccatttcggcccaccaattgcactaagtagcaccgcatcagcttgttttgaaacatcaatagttgactgtggtagagggtcaccagctcgatcaataccatcaccaccaaatggtgcatctataagttcataagcaaatgttgtatcctttgtcgcagcgtccaatactgctaatcctgctgtcatgatttccggaccgatataatcgccttttaaaactactatttttttaactgatgtcatattattgataactcaccatttctttttcttcaacgacttgcataataacctttaattgatcatctgtaatcaaatcagactcttcggcaactgatttaaagattgggaaaattgatttcatatcaccacgagtcacctcataacctaggctatttagttttgacattaccgcatgcgatcctgacaattttcccagaggtagggatgccgtcgcaccaaccatttctggcttcaaaatttcataagtttctggattttttaagtaaccatcctgatgaatcccagattcatgagcaaaggcattgcgtcccataatgggtttattacccgcaactggcatgcgggttgcgcgtgcgacaatgtcagaaatggcttttgactgagctaagacaatatctgtttctgcattaaacttttcatgacgcacatgaatagctgctgctgcttcaatcatatcaacgtttccggcacgttcaccaatcccgttgattgtaccttgaatttccgtcgcaccatgctcaatgcctgccaaagcattagccgttgccatacccaaatcattatgtgtatgtgttgaccaaccaactgtgtcaaaaccaacaatattttgacgcaagttttcaaaaacttcaccgtattcttctggcgtatcataaccaactgtgtctggtatgttaatcattgttgctccagcgtcaatagctgtttgcacgctggctaccaaaaaatcaggttcagttcgtgtcgcatcttcaggtgagaatacaatatcttgcatatgttgcttagtaaaagtaacgtctgctttgattttgtccaaaatttctgctttggtcatgtgtaatttaaactcacgatgaattggtgaagttgcaatgaacacatgaatcattggatgttttgcatccttggttgcctcaataaccgcattaatatcatttctgaccattcgtgccaaaccgacaacttttgcgttatccacaacttctgcaattcttttcacttcttcaaagtctttctgagaagccgcaggaaatcccgcttcaattgctgcaacgccataatcatccaatccttttgctatttcaatcttttcttcaattgaaaagttaaccccaattgtttgttcaccatcacgcattgttgtgtcataaaaagttactttgcttgccataattttctccttaaattaaaatcccggaccagtcaatttgactagtccgggatcatgcactcacatccttttattcactagccattagataagtacctaacaaccagctcaaaagctcaacttgctagggtagtctaagcaagttgaggagaagggctgcatttgtaatattcgtttgtacagtagcctgatttctcatgtgaaacacttccttttaatttaataatccaatcataactactttataattcatcgtcaattacaaggtgtgttttattccaattttatataatttagtcgttttataatcctaacgccatttttgcgtatcgcgacattcgatcaatttcccaagctggttcccatgtgagttcaactttggttgtctttacttcaggtaaaatttttaatgcttcgtcaatcatttcttccaacacactaattaacggacaccccatcgttgtaagcgtcatattaatggttacatcaccgatagaattgatatcaacagcattgattaatcctaagttaacaatatcaactcgcagttctgggtcaatgactgtcgttaaagcatccatgatacttgcctcaacttttttattcataccttatcctaccgatcccaccatttcaaatttcattaatcgatttaactcaacagcatattccattggcagttcttttgtgaaaggttcgataaagcccataataatcatctctgtggctttttcggcagaaataccacgtgtcattagataatacaattgctcttcggaaacacgcgatacttttgcctcatgctccattgacacattaccattcaaaattgtattgtatggaatcgtatcagctgaagatttatcatcaactaaaatcgtgtcacactcgacgtgagcaaatgacccatcagattcgcgaccaaatttcactgtgccacgataatctgtagaaccaccatcgtgtgcaatcgactttgaaatgatagatgacgacgtattttttgcattatgaatcatttgcgcaccagaatctaagttaacgccctcgccagcaacagcaatcgatagcattgttccctttgcgccctcgccttccaaatatactgatggatacttcatcgtcgtttttgaaccaaaattaccatcaacccattccattgttgcgttttcatgcgctgctgcacgttttgtttctaatgaatacacattattagaccagttttgaatcgtagtgtaacggcaatatccgtcttttttaacaatcacttctaccacagcagcatgtagtgcatcccctgaatacattggtgctgaacagccctcaacgtaatcaacatgcgccccttcatcaacaataataagtgtccgttcaaactgaccttcattttcagtattaattcgaaaataagactgaataggtgtcgtaacgtgaacacctttagggacataaatgaatgtaccaccagaccaaactgctgaatttaaggccgctaatttattattggttggtttaaccagtgatccaaagtattcttgaataagctctggatattcttggaccgcagtatctgtgtcggtaaaaataatacctgtcttagcgaattcttctttcatccggtggtaaaccacttcagactcgtactgggcagaagaccctgctagccacttccgttcggcttcaggtacacccaaacgctcaaaggtttcctttaattcagctggtacatcatcccaatcacgatatttatcatttgttggcttattatagtagtaaatatcttcaaaatgaatttcacttagatctggcccccatgtatgcataggcattctgaggtatgtttgataggcttgtaaccggtagtctaacatccattgaggttcattctttttagctgaaatttgacgaataatgtcttcgtttaacccttttcctgttgaaaatacagcctggtagtcatcttgaaatcctagttcactggccttgtcatttgaaatggctgcttttgtttgattaatagcttcttgtctatctatttccatcatcgaaacctctttatttctctactgataataactcgtccaaggcatgccatgctaaagttgcgcactttattcgtgtaggaaatttagtaacccctgctaaaatttgtgcttctccaagaggttttgtatcagctacttcgccacgtgtcagttttgaaaactcctcaagtaaggtagcgacagcttcacgacgctgtcccagtactaaatctgtcatcattgaagccgaagcctttgatatagcgcagccatccccataaaaatatatatctgtcactttatcgtcagtcatctcaaaagctaaatcaataatatcaccacaagtgggattatattttcgaacatgataagtttctgtacccaacataggcttataatgatgcggatgttgggcatattccatgactgtttgacgatataaaagatctaaattatgcaaactcacggttaaaatactccttaatatcttcaatgacactaagaaatcgatcgatttcttcacgcgtattatagatatacaaactaatacgaactgtcgctgcaatattcaaatatttcatcagcggctgcgcacaatgatgtcctgcacgaacctcaatcccttcttgatccaaggccgttgctaagtcgtgggcatggacccctgctaaattaaatgcaatcacgcctgaatgctgttcactgttttgcggaccataaatggtgacacccgcaatactttttagctttggcaaggcataatcaactagagactgctcatagttttcgacctctttcattccgatatttgtcagataatcaatagcggatcctaaagcaattgcaccagcaatattaggcgttcccgcctcaaaacgccatggtgaaggctgaaaggtcgcttcttgcaagtctaccaattcaatcatttctccaccaaattgagcaggtttcatattttctaaaatatcatgtttgccgtaaagaactcctatacctgttggtccaagcattttatgacccgaaaaagcaaaaaaatcaacatccatatcttgcacatcaacacgcatatgcggaacagattgggcgccatcagcaatcatgatagcatcatgtttgtgggctatttttgcgattgtttttatgggattaacaacccccaacacattagaagcatgtgtgattgatacaattttagttttgtctgttattttccgttcaagatcagccatatttaaggtgccatcgtcattgagttcgacatattttaaatgagccccaacacgttgcgctaattgttgccacggcacaatattagaatgatgttccatgtaagatattaggatttcatctccttgtttaacattttctgcaccataagtacttgccaaccaattaagcgactcagttgtgccacgagtgaataaaacttcttcccgtttttgagcatgaatgaatttttgcactttatcgcgggcttgttcatattgttgtgtcgcacgctctgatagctcataaataccacgatgcacgtttgcattattattttgataataattcactaatgaatcaatcacatactggggtttttgtgacgtagccgcactatcaaagtagagcagctcttgcccattgactgtttgatttagtattggaaaatcatgtctaatcgtcttcatgtcgtaactttctttctatttcttcaactacttgcctttgtgccgcttttgttggcatttttgctaaaacttcacccataaagccgcgaataactagctttcgagctacttgctcactaataccccgactcattaaataatacatttgattttcatcaacacgtcccacagaagctgcatgccccgccgtcacatcgttttcatcaattagtaacaaaggatttgcatctccacgtgcgcgacgtgatagcatcaaaacacgcgattcttgctgcgcatccgatcctttagcgcccttaataattttcccgataccattaaatactaaagttgaccgattgagaataacgcctcgttggaagatatgaccaatggtatggcgaccacgattcaaaatggttgtcaccaaaccttgcgtttgtttttttgtggtaagtccgatgacatttgtatgtgacgtagcgccttcaccatttagttgactagctaatcgtatgattgcattaccgtcattaaactcagcattttgccaatccacagttgcatgatctcttacttcaacttctcgattaataaatgctgtcgtttgttcaccaaaggcatcaatattagcgtaagtgacttgggcacctacatccgctacagcttcgataacaacagaagcctttgttttttgagtcccgattgtatgcatttcttgtagtatgtcaaccttggcattggcgccaacgcatacaaaaatacgagccacaaaatcctctccagatatagctaaatgattcaatgacaggtgcaaaacatcatcaaattgaacgttttctggtatatagacaaaaattcctgtgttaaactgtgcaaaattttgtgctgataatcgatcggctgttttggaaatcacactacccaccagcttttcaactaatgctggatgttcaatctgtgcttgtgccatattcatcagaatcactccacgagcgatcatgtcatccgataattgctgataagtagtggatagcccactaacttcgatgccgtgaacattattctcagtgaaatatgacgttgtcgtttcttccttggctgctaccatttcatcaagttgccaggaactgtatcgaactttagcaaatgttggtagtggtaaagactgtattgcgctattatcaaccatatcaatcctccacaaaatacgaattcacatcttcatctgtcaaatgaacgttcaatccgagttcatctcgcaatcccgcatatccctcagattctagtttcttcgccaaatccgcaccgcctgttttaactattttcccgcccatcatcacgtggacaaaatcaggcacaatatagtcaagtaaccgttgatagtgcgtaatcataagtgtgccaaattcactggaacgcatttcgttaacaccacgagaaacgacctttaaagcatcaatgtctaatcctgaatcaatctcatctaaaatagcaattttcggctctatcatcatcatctgtaagatttcattacgttttttttcaccgccagaaaatccttcattaagatagcgttctgccatttcttctgacatcgataaaaattcgcgtttttcatcaagtttttcaataaaagacataatactgatttgatcgtcttcagcacgacgagcattgatagctgcccgcataaattcagcattggtcaccccttgaatttcagatgggtactgcatggccaagaatagacctgcacgagcgcgttgatcaactgacatgtcagccaaatcttgatcatccatgtaaatatgaccttcagtaacttcatatgctggatgtcccataattgtttgtgataaagttgattttccagtcccattaggtcccataatagcgtgaatttcaccagtgttgacgactaaattaacgccctttaaaatttcttttccttctactgaaacatgtagattctctaccttgagtgttgccatattatttttccccttttcgctgactgattttttgtaaaatagcttcgtttttatgtattttagcaatcacacgcgcattttcaatcatctcatttacaataaaattctgactatcccaagtatcactagcttgcaccaatagccaaaaaaagttttctaagaaataagtactatcgcttgcgctcgctaaatcaatgccataagttgccaacatcatagcatatttgtagtttttaatcgacatttgatattgtgctaacaaataaacaatcgccgcttgaaatccagaatggtctactgttgtactttccttttggtagcgccaaacgtcttcaaaagcctggtgagcctctttgaattggcctcgttgataatagtaatgactcgttatggcataaaacaataacttgtgtgacttgttaagacctgctatatcaatttttttaatgatttgttttgcttttagacagtcttgttttaagataactgccgaaaaatattgcgtaatttgataggttggccgttcggtatcaaccattttatcgatttctacttgtttgattagatgctcaaattttccaatattttgataaaagagtgcttgtgtggccaatgttaaaacacgctcattgtttgtttgacgcgcagtaacattgattggaaaaacatcattcaacgttaaccctaaccgttcacacagagcaatcatgatatcaaaagctggcacttgttgatgcttttcaaatttggacaaagtagcttgtgtacagatatcagtacatagcgccatttgtgaaatttttaagcgttttctcgtgctgataaatttttctatgtttatcattgatcccccaatcctatgaaaaaaggcacctaactgcgttcacagttaggtgcctgaacaaaaaatgtcccaactgtctactaaatccaaatcgattagtagacattcactcaaaataacctactaatcatcagctgataagaaggataatgagaatgttgttcaatttttttatatttttattcattatgttatctttcgtttcttagtaaaaactcacattaatattgaaataattatattcctataattttaaaatgtcaaacgttatcggaagataagcaagattgtctctatatttttacagtcatcgtcataatctggtcattttatagatgaagcgataaatcatataaatttggaatagttcgttgacaattgagtttatacccctatactcatattagtaaaaacatattaaaacttagaaaacgcggagatttatttcatgacagacactttttcatttaatgtaaatagcgatgacttacaaaaacgatctgatcatatcaaaatgggtattcatcaagctccagcccgctcgttattatatgcgacaggtcaagtcagtaaccccgaagatatgaaaaaaccattcattgccatctgtaattcctatgtagaaatcatccctggccacgttcatctgcgtgaactagctgatgtcgccaaacaagccattcgtgatgccggtggcattccttttgagtttaacaccattggtgtggacgatggtattgcgatggggcatttaggcatgcgctattcgttgccatctcgtgaattaatcgccgattcagctgaaactgtcatcacagcacactggtttgatggtgtattcttcttaccaaactgtgacaaaattacgcctggcatgattatggcttctttgcgctgtaatgtaccctctgtattcgtctccggtggccccatgaaagctggtttagatcctcaaggaaaagccacgactttatcttctatgttcgaggccgtgggtgcatttaaatcaggactaatgactgaggaagaattcttagaaatggagcaaaatgcctgccctacttgtggatcttgtgctggtatgttcacagctaactccatgaataccttaatggaagtgatgggtatcgccttgccgttcaatggcactgcactagcaatttctgatgaacgacgtgatttaattcgcgatggcgccaagcaattaatgcgtatggttaaggaaaatgttaaaccacgcgatttaattacaaaagaagcgcttgatgatgccatggcacttgatatggccatgggtggctcaaccaatactgttttgcacgtgttgtctatcgctcatgaagctggcattgattatgaccaagcagacattaacgaaattgctaaaaaagtaccttacctatctaaaattgccccttcttctaaatgggcaatggaagacgtgcataatgctggtggtgtgcccgctattatcaatgaactaattcgtatgggtgacgttttgcaccctgaccgcatgactgtaaccggtaagacattgcgcgaaaatgttgctgatcatgaaatcattaatgacgaaattatccggaagttcgatgttaatccctattcaaagcaaggtggcttatccattttatatggcaacttagcacccaaaggttcagttattaaagcaggtggcgttgacccaagtattaaagattttaccggagaagccattgtctttaattctgaacaagaagcggttgaggcgatagatagcggtcaaattcacgctggtcacgtgctgattattcgctatgagggaccaaaaggtggccctggtatgcccgaaatgctaggacctacatcagctattactggtatgggtctaggaaaagaggtggctttggttacggatggccgtttttccggtgcatcacgtggtatctctgttggccatgttagtcccgaagccgctgatgatggtccaattgcactggttgaaaatggtgacaagattaccattgatcttgtcaatcgtacgatgcatttgcatgttgatgatacagagctagcggaacgccatgaacatctcaaaccctttgttcctaaaatgcgaaatggctggatggcacgttatcaagccttagtcacttcagcaaatactggcggcgtattaaagggcgctgatgaattattccctagctaaaagctatcctcaaatgtcataaaggacgctgacacatggaaaataaaacacaagaactacaagaccagatgttggaagccttatcacaggtaatcgaccccgaactgcgttgcgatattgttagcttaggattagtttatggactagctatggatgaaaatggacatgtcactgttaagcttactttgaccacgatgggctgtccattgactgcggtattagatacgatgattacacgtgcactcatggcaatagatgaagtacacgatgtcaaaattgaattagtttgggaaccggcatggtctacggacagaatgagtcgctacgcaaaaatggttttgggtgtccataattgaaaaaaacagccaatttattataagttactgggagagcaactatgaacacaatcaaatcactttcaaaatttcttactaaatactttaccttttttgttattttagtagctttattggctatttttattcctggaccaggtactacgcttgctacaacaaaagtgggcaacctctcggctgtatcaatcttactgatgattgtcttatttggtatgggtattacgttgacaccaaatgactttaaaagggttgctcgtaatcccctacaagttattttaggaacgatagcacattatgttattatgcctttcattgcttttttactggtacatttgtttgggttaaccggcgctgcagctgttggtgtaattttggtaggatcagcgccctctggcacatcctctaacgttatgtccttcttatctggaggggatgttgcgcttgatgtttcaatcggcctgctctctacattgttagcacctgtcatgattccgacactattgaagctattagccggaaaatgggtgaatgtacctttttcatcaatgtttttttctgcatttcaaattgttgtcatacctattgttttgggtatcatcgttcatacgatttttaaagaacatgtccaaaaagtcattgagattatgcctttaatatcccaagtggctatattagtgattattctagccgtgttgtcagctaactctaaaaccattttagcagtatcaaccctaattttggtgccagtcatcatattacataacttgcttggttacttactgggttacggtttctcgaaactaatgaaaatggatacccctcaacaaaaggcaattaccttcgaagttggtatgcaggattcggcacttgcatcaacactggccatttcattttttgaacctgcttcagccatcgcagccgtgatgttttctgtctggcacaacatttctggttcagtattagcttctctctggaaaaatcacacagagaaagcaccagactaaaaacattttaaaaagacgatgaattcaatatcatcgtcttttttgataaaaaaacgccagtttattactgacgtttgaataatctgaactttaccgcaaaatttcgttttcagtaacgccgccatttaccatcgttacggcatcatttaaagccatttccaccatattttttattgctgtgtttgtataaaaagcaatatgtggtgacagtagaaagttgtcatattcgattaagcgctttacatctgctggtagcgccgttatatcttgcttttggttcataaaatcattttcatttggtgtcacatcaaatgctgcaccagccaataactttgattcgagtgctttttcaagctcaaccatgtcaacaatttcaccacgcgcaaaattcaacataattgttcctggctgaattttagcaaagaaattttcatcagccatatagcgcgtctcgtcatttaatggtgtatgaaaactaataacatctgctcgagacaaagcatcatctaatgtcgtataagttacaaatggttcgttctgggcacgatatattgggtccacacctaacactgttgcgcccagcgcgtgaagcatttctgcaagggctgtcccaattcgacctacaccaatcacagcaacagttaaatcatgaatttctctcgcttgaccaccagcagcccaagtatagtcacccgtattcatggcgcgatcaaactttttattgtgtcgaattaaattaaaaagctgtgttagcgtgtattctgcaattgctcggggtgaataggctgcaacattagacaaacgaatattgtgagcaaaggcttctggcaagtccaacacatcatagccaacctgtcgaatagcgatttgcttaatattgaattgagctagttgcgcataaactggtgcattaatggctgttgtttgttgtgtggtaattgcatcaaaacctttagcgcgatccaccgtcgtttcgttaagtggttgatcaatggtcactacttcgtggcctgttttttcagtccatttttcaacatatggcatttcgtctgaaactgtattgtacattaaaattttcataatatcctccaaaggtgcgctagcaataagttatttaacttttcccaagaaatattttttcttaccacgacgaaccaatacaaattcaccatcataatgttttgttggatcgatttcaaagttaacgtccgttactttttcaccactaatggtaatcgccccatttgtaacgtcttcacgcgcttgacgctttgatttctcgacttctccgtcgactaagaaatcgacaacatttttcttttccgatgtaatgtcaaagcttggcacaccaccaaatgcatcagcaatatctgctgcagataaattagcaacatcaccactaaataatgctgctgatagcttttcagcatcagcaacagcttgttctccgtgaacaaatttagttacctcttgtgccaagcgtttttgtgctatacgacctccagggttatttttggcttcttgttcgaggttattaatctcatcaacacccaaaaatgtaaagtatttcaaatacttcacaacatcttcatcactttggttataccagaattggtagaaagtgtagggtgaagttttttccggattcaaccaaattgcatttccttctgacttaccaaactttttacctgatgagtcagtcatcaaaggaatcgttagaccaaaagctgttgcattattcccttcaattgagtgaattaaatcaatgccagacgtaatgtttccccattgatctgagccaccgatctgcaattgtacattatgacgacgccatagttcatggtaatcaatgccttgcaaaatctggtaggtaaactctgtaaatgaaatacctgtttctaaacgtgaagctacgacgtcctttttcaacatcacattgatagagaataacttaccataatcgcgtaaaaagtctgtcaatgttaatttgccaagccagtcgttattattaacaatagcagttttttcatcaccaaatagcttggttacttgctcagtaattcctttttcattctgacgtaactgttctggtgaaagtaattgacgttctgttgttggacgtggatcaccaatagcaccagttgcaccgccaataataataacggcttttccgccagcattttgaaaacgttttaacaccataaatggaatcaagtgccccaaatgtaatgaatcagctgttggatcggtacccacataggccccaatttctcctgatgccattgcttcaattaatcctgcttcatctgttacttggttcagcgcaccgcgccatttcaaatcttcaataaaattcattgccatctcctttaattacagaaaaaatcgtcctaatcttaatagactaggacgattttcaccgtggtaccacctaaattgtaagtcatcggacctaccacttaatatgccttatcgcggcacacgtcattgatttgcacactgtgtaactcaacaatatccacggattagctcacagcagccgctaactctctttgacgcgtatgatattatctttatcagtgtaatgaatgtttttattataccagaatattagataaaaaaggacattttaattttacaagaaaacgatcagaatgtttcatgtgaaacattctgataacagcctataataaattactttgacaaccacagtaatatgttatattatgtagttataagaggtaactgcatatggatatatcaaaagatctcattcgtggtcatacggacaccattattttaaatattcttagtcaaggtgattcttatggataccaagtttcaaaatccattcgccaattatccagtaagcaatacgaactgaacgaggcaacactgtacactgcgtttagacgcttggaaaaggtcggagacatccgtagttactggggtgatcaaacccagggggctagacgaaaatactatacccttactgatcagggccaagaacattttaaatcagcacaacaagaatgggacttcgccaaagatatcattagccatttaattagcggaaggataaaagattatgatgagcgttgaaatggaaattagaacccgtttggatgttattttttctaaatatacgccgaacgcacaattaacggaatttaaagaagaacttgtagccgatttattagaagcttatcaagatttttccaaaactgatcggtcccataatgaagctttggacgatgcttttgagcaactaggtgatattgatagtttgttaaaggacttaagtgaacccagtacaaaagaggaaacagataaagaatctgaaccaaaacgaccttacgtggatatttcaaataaaggcgtgcacattggaaatttacacatcaacaaaaaaggcgtaacacttggtgatgatatcatacttgatggcaaaaataataaagtccaatttggtgactggttgcacgttgaccgtgatggcgcccgtgtgggcgataaatactataaatttgaagataatgttgattcagatatcaatgatacttttgaaaataaagacttcaaggaacctaactgggctaaatctcaccatcaattgaccgtgccaaccagtaccaaagattttgtaattgattacagcgaagcttcgattcacttctatacaaatgataaaatcgacctcattactattgatgaatactttagtcgtgataatagacgttattttgccactatctcagaaaatgatgataaaattgtagttaaccagggtgaacatccaatgctcttccatgtccgcactgctgtgaacataggaattccgcgctcgttcaccaccgggaaaatagaagtacgaaaccaagcaggtagcttatatgcacaagacttagttaccgagaagtttaacgttcaaattaacgccggaagtttcaaagtcaaaaatatggataccaagactgcagattggcagcttgcatccggatcaataaaggcaacacatatcaaggctgaacaagctaaaatacatgctcaattaggtgctgttaatatcagcgatgcaactattgattatgctaaagttaacgctgactttggttctgtacgtatagacaatcttgttggtggcggagaattcacgattaattctggttcacttcgtttgagagttgaccaactaacaaacgatttgaaactaaactctaattctgggaccattcgcttgacagctccagctgatcaagacttcaattttgaactagcaactaactcaggggcagttcatttggatcgcaatgacatccattataataaaagtttcgatggctataaaagtggatttgttggcgctaaccctgaatttacaatcgatgcacaagcagatatgggttctataaagatatactagtacctatatttgatttctaagtctaaatcaacaattattacatggaggaataacaatgacaaaacataaaaaattaactcgctcacgtgataaccgtgtgattgccggtgtccttggtggaattgctaactattttaattgggatgctacgttagttcgaattattttcgtggtattaggattcttacccgttctgcctggaattttagtttatattatcgcttgggtgttgattcctgatgaaccacgtcagacacattattattcagacggttccagaaaagatgtcacacctgatgactacgatgatcgcccttaattaaaacattaatctcaaatagaccctgtggatttttttcatatccacagggtctatttacttgctttgcaaaaacgcattgttagttagtattttgtctgataaatgccaatttttttgcatgaatatcatccgtgttgaaatcacgtggtccatgatgcgcatcatcaactagtatcacctcagctcttttacccactttctgataatacttttcagccaatgaaacactctgtaaataaggtactacgtcatccttagttccagcaaataataacaagggcggcatattctttgaaaaataagttgctgggttcgcttgtgcaactttgcttggcatctggtccggccgtttggtacctaacattattccttcaaatgactgtgcctcaccagtttcgctgaactgtggttttatgttgagagcagcaaattgtttagaaaaatcgtcaactttgtagggcccatacatcccaatcacacaactaatttttggaaaaaacgtgtgttccgctacatctttgagtctgcccaacaataaatgctcagatattgttgctgccgttaaaacagctaactgggctccgctagattccccaatcaatataatgttgtccttatcaaggccatactgctttgaattctttatcaaaaaatttattactgcacgaatctcagcgatttggacagggaaagtttgttcacctagctgattaagtgaataatctggactcactactgcaaaaccatcattcaagaaccgtaaactgggattaagtttatatgaggatttttggcctcgaagcatacccccaccatatatgtctacaataactggacaattctcccccgctttaggtaaataaaggtcaagctgattacgatctccaaccgaatagctaagattatgaaacaccctagcattttttggcatatttgctggaacatatttatatgttttatctttgaataacatactttcattataaaacaattaacgtatccgtcaaattgtaataataatattaaaactgatacaaattttaccactaccagcttataataagttaaaatggtttaaatataacaattggagaacgttgtatgcttcaaaattctatacaacttacagataacaagctacgtgaaatactatttgctggtcgttttggtattgaaatagaagaacaccgtgtacaatcaggaagtaaaagcctatcccaacatccacaccctcgtgatttaggcaatcggcagtatcaaccctacttccagactgatttctctgaaagccaagaggaactagtcaccggtactaaacattcttcaaaagatgccttaatgcatttgcacgaactccagactattttggcatctgaactggctgaggatgaaattatttggccactttcgatgcccccacatttgtctgccaatgatattgattatttgcttaatcattttgaacgatcttggtatcaagaatatcgggatgttttagtcaaacgttatggaccttttaagcatattatggctggaattcatgttaatttttcaccagctgacgacttagtttggtggtttggctctcaaaaagaaatcaattcctatcctgctgccaaaaatgagttatactttcaaatcgctcaacagatagctagttataggtggctactgacctatctttttggtgcaagtcccgtttctgaaaattcaacagatagtttaccaactaatttcaaacataggcaagcggttcgctcttggcgcgccagcaattttggttttgcaaataataacgatattgaaattgactatactaactttgaaacgcatatgaaacaaattcaacattatgttgatactggccaattctatgataaaagtgagttttatggtccagtgcgtttaaaggctccaggaagtttgactaatatggcacaacgtggcgcctcatacctagaatttaggatgtttgataccaatcccttcacactagatggtatttcacaagatgcgttaagcttcctccatttgctaatcatcgatgccatcattaatccacagcaatggtcagatgacgacctaaaaagcgcgcagtctctaaaccatatggtatctttacaacatccaaatgctcccctcatcccatcactcgccacttctgctaaacaattgattcaacgcttggaggatattattaagctgtcccccgctgaactacaggaagatttttttagcgctctcacattcgctaaggatgcccttgctgatccaacgaaaactattggggcccagttatcaaacttcattagtaatgattctctggaaacatttgctttgaaacgcggacaacagattttgtcagaacgaaaatccagcagtaataattttgtttttgccccaaatcatttaaaacaaacttacatccaggcgcataaattaggatttaaaacattattgcgcaaggacaattgtctacaaataagccaaaacgaccatgtctggacgttcacaaaaaatacagacttaactaattatgtcaaaacaaaaaagtaatgatacggactgtatcattacttttttagtagttgttatcttaaaatatcaatcaggtttttattacttgctgtttttgctggtaaaataccaaacactagaccaacaactgttgacgttccgaaagccaataagaatgttgatagtgaaacactagctttaaatggtaggaaagcagaaattcccatcgctacccctaaccccgcaaggtagccaatcatcccgccactaagtgttaacataactgcttcaatcaaaaactgccataaaatttgtttctgagatgcccccacagccatccgaataccaatttcttgagtccgctcgctgactgcaatatacatcatgttcatgaccccaatgccggcaataaataacgaaatacttgcgacagcaacaataaagtaagtaatacccttaatgactgctgttatacctttaagcatagctgccgtatcaaaaaactcataggatccggaagcatgttgtgaaccaattttattgagttgatctttaatatcagttgttgctttagatatatttgttccagacacaaatgttagctttaaggtattcgcattaaccgttgcgttactgttctcaaacacgtgtcgtggcacaacaacgtcgtaattgtaaaattcaccctttaccgcattattattaataataccaacaattgtatacattgtgccattgatttcaattcctgaattcaacgcatttcgatttgttcgataccccttcttggcaattgattgactaaccaatgcaactgggttatccattgagatatctgttgctttaaggccatgcccagtaattatctcactgtcatttgctgttgttgctaaatatactgatgctgttaagctcttaccattaatggtcccctcactggataagataccatgatcatcagactgtaccgtaactttgctgactttggcattagcgcgaatacgcgctaaatcatcattattaaatccggaaactttagcatcattacttggcgaaaatgtaatttccgtcgactgctgtccactactatcggcctgcaaatttttcagcatttcaattcgtgcaccatcgccaagagataggatggtaatcaccgaagcaataccaataataattccaatcatagttaaaatactgcgacgtttatttgaaattaatgacctgaatgaactgacaattaactcacgaacctgcatgttgcacctccatgtcactttgtaaacgaccgtctaaaattctaatcagacgatttgtttggcgtgcaacgttttcatcgtgtgtcaccataatgattgttgttccattacgatttagctcttcaaaaagtgccaatatttctcgagatgtcgccgaatctaatgcccccgtgggttcatctgccactagaaagttaggccgtgtgacaattgcacgagcaattgcaacacgctgctgttgtccacccgataaatttttaggtagtttatcataactgccgggcaatcccacttgctccaacacatcatttacacgagcaataatatcacgtcgcttcaaaccagcatataataacggcaacccaacattttcgcctacactttggttcctaattagtttgaaattttgaaaaataaaaccaactgattgattacgcaatcgagcatgatcgcgtctattcaaatcattaactacagtgccgttgaaattatattgtccatcaaaattattgtctaaaaaaccaataatgttaatcaatgttgatttccctgaaccggacggtcccataatcgcaacaaattcaccagcatcaatatttaacgaaatttcatgtaaagccttataattctcgtttccctgtcgataacttttgctgactgaaactaagttaatcatcaacaacctctccgtttgtcaactttgcatccggattagtaaccaattcttcccctttactaataccagagttaacaatgtacgtatctccattttgcgttaagtcagcttgagctcgactagccttaccatcaataactttgtaaacactacctttatataccgctgatttcggaattttcaactctgactgcggcacctttactttaacgctttgtccgtacaaaaagtcgttattaacactggcagagaaaggataatacgttgttcctttgccctgattagatggaatttgttcaatttttgtaatcttagtactttgttttggcgagccatcaataccgctcactgtgacaatatctccagcgtgtaccttgctgtaatcatattctgacacattagcttgcaaaactttttgacttgaattcattgtaatggctggtataccatcttttgtatcattactaactgaaacaaccccgtcaaaaggtgcctttaaagatacagttaatttaccttgtaattctgctagcttattttgggcatcttgcaaatcaccatttgcatcagttaatgcttgttgcgcttgtgtaacagtgtcctttagcgaaattttagtatccgcatctgcttgattgtaactttgttgcgcatttttaagagtagctgatgcgctgctaactgcgcgattggctttatttacaatgtcctgttgtgaactaatagactcttgcacgtctgtagcagttacggtaagtaaaatatcaccatttttaacagactgcccgtctttcacattaatttgttgcaatttcccagttggtgagtttaaagattgtgttttttcagcaaccacttttcctgacattgtaagtggtaaggcgccggttactttatacacttgatacttgtttttagcagttgatgttggctttaccagtttatggtaagcttgcacgccagtggcagttaacataccaagtgcagcaatacttccaacaacagttactataatttttgtcttgcgtttcatatacttcccctacataacatgttaatgattattcaaaactctttacatctcgttaactacaaaaagttaaaacgcaaaggccatcccagtgcctagagctactgaaatcacaataaaaataatctgtgtacgttttgtaatcgtaccatcctgacgcaaaattaatgtatataagaatgtcgcaacaagatcaccaataatgcttgctactttattatcattcttatatagattcaaaacagttattagaaacagattaatgattccaacaggtaacgtacttactactgtggcgtaccatgaattcatgaatgatacggattgctttgcctcttgaccaagttgcgaaagaaaaataaataatttgctgaataacgcactaaatataacgtatgctgttgctccaacagctatactaatcattacatacaagttttgagtactagattcagtaccacttacgtcttttatagcgatcaaactactaaccatcgttattccgattagaaccaaagtaccaacgattgttaacacaatcttaactgtttttgtcatatttctccctgttgattaccaagactacaagattcatcatgcttgcacctaataatagttcaaactgtaacaatacttgaagtaaaatagatgagttttgaaaatatccccacagactttcaaaaaatcatctattttttaaatacaagtataagtgaactattcagataatctcttttctcctttatttgtatcaggcctatactatttagccgatagttattattatatcaaaatcaatacgaccaaaattcatcaaaagttacgtcatatcgtattttttgcgataaatattttattgacttttgttgtaaaatctgataataattgttttaattaaacaaacgacaaataaatgtcattttttacccatgtttttcggactttattattaatttataaaaaagtagtggtattttcatgtatgaaattaataaaataattaaaaaaattagagatgacaacaaactcacgcaaacagagtttgctgcttttttgtctgtatctcaccaaactgtttcaagttgggaacgtgcgagaacccggcccacacttgtgatgttgaaaaaaatatcccaatcatttaatataccactttcaaaattattacccgtcgataaggtgccaaagaaaagtaaacgtgatctggataaagaaaaattagcccatgcattcttgtgcttattatctcgctctgatatgcgaaaagtcactatgcaagatattattcttgagtccggcctaagtccacattatgtctcatcgcttttttcaacacctttggatatattaacttttattgcgatgaaaatcgaacaggaaatatcaattgcgctggaacatacaacagcaactgacccttttatcatacttgctgatgttatattgcctattttatatcagcattgtcacgttctaaaaatactctattcgaaaaattatgcaaatggcgaatggctgcattttttagagcagagatacattaaatgggtgactccgttttttaataattattgtgttgaaaacgccccagttagtcgatcatttgctattgaactcagcgtgaaaatgacactctcaattatttcaacttggctaactcaacctatccccgaaacaccagaaacttttcgagttcatttcttacaattaaccaagatgtctatcactgacatagccactttataatttttaaataaaaacaccgtattttactaatacggtgtttttattcaataattatgcacacagtataattattggttttgattaatttcatattgtgattttgttaacttttatatcaacagagctatctcgatatctatgaataaaaatacaagcaccatgtattatacctgctttcatcattaataatggcacttaaattataaaactaagaatagtattgcttttttatgttgtttgttttatacttagaaacatgaacaagcaaatgaactcacaagtaaacaatacaattatcaacgcaattattattatttaatagttgggttgttatttaacgtaacgactcgtaatatctggtcgttacggttataaaggagtttaaaatcccatttaataactgtaatagttattaaatgggattttttgtttgaaataacaataaaagaggaaaatatcatgacaacatcaacaacacacaccgtacaagaattaactactaaactcttccaagcatttgataccaacacgccacttgaccgagacgaatatgtcggcgtcgttgataatttcgaaaatgcctataaagtccaagatgccgttcttactcaaaagaatgctccagttgctggttacaaggtttccttaacgtctcaggaaacacaagatttatttaactctgattcaccactatatggtgcccaattagctaatcgatttgtccaatctggtttcaatttagatttaacagcatacaatgaaccgctagttgaggtggaattaatgtttactgcaaagaaggacctaaccccatcaatgagcgaagtagaactactccaaaatacaactgttgcaccaactttagaattaccagatgcccgtttcaaaaattggttcccaaagctcgacaagtatctcgttttgtgcgatgcggccgtagggggtgcagtagtttatggtaatcaacgtgatggcgctgacttagctttagctactttagctcgtgtttcagctgttctgtcgcacaatgatcaagaagttgccaatggcgttggcagtgaagtccttggcaacccagttacatcactaaaatggcttgttgaaaaactattttcacaagacaaagattttccagcaggaacgcatgcttcgacaggaacatttctactccccttgtcacttacaaccggcacttggaaagcgcaatttactgaaggctttggttctgtttcggttcatgtgaaataataataaaaagtgttccacgtggaacacttttataataggcttgtagctcaatggcagagcgttgcgctgataacgcagagatagaggatcattacctttcaggccgatatatactaaatttaaaatagaatttttattaaaataatagcaagtatgacctgtactgcaccagtcacaaggccaaagctaagaaactttcccccagactttctgattgtgtccaacttaagattcaatccgattcccgctaagttcacgacgccgaaaaacccagaaatctgtttggctccacttgttattaagttgggtaatggaataaaactattaactaatagtaaaactacgaatgccatgatgaaccaaggaattttgacacctttactattaatatttgttgctgaatcgtcttttttttgtgccattttagcaaaaactaacacaacaactgtcaacatgatgacacgtagcattttaaacagggtcgcatacgtgacaacagtagtattaatcaatgatgctgttccaacgacttgcccaactgactgaaccacaccaccaactagtgcacccaacagtaagttatggtctcctaacacgtgtggcccaagaatcggcaatatcagtaacaacacaacaccagtcaaactaacagtcgcaacacttgttcgtcgttgatcatcagtggcccatatcgctggtgctactgatgcaatagcacttgatccacaaacagcattacctgcgcccattaacatggaggatttgtcagaaactttgaaaacacgaccacccatccaaagaacaaccaaaatagttaatgtcatctgtatcaaaatgaatgccaagccattaataccaagattttcaatggtccggagtgtaacggtaagccccatcaacgcaataccaatttcgatgggaaatttttctgcccatttcatccccggtgcgaaagatggctgattcaaaacagtattacctaataaaatacctaataacattgcgattgcttccgcgcctaaaaacggcagccacgtagctaatactttagcaactgcagacaatattaaagtaatgataataccagaaatcatagtctttttaattttcatgtcaattctcccacacgtttaacagcaccaatgggctgctaaattctaatttcgatagttattatgttacccccacctttgctatttgtaaaataaatatttataatatattcaattaagtattttaataggaagtcatatgtttaaacgaatccaatcctttatcgcagtttatgaaacacgttctttttcaaaggcggctgaacaattatttatttctcaacctacagtcagtgtgcatattaaacagttagagttgcaattaaacactacgttatttgaacgaaacgggcgtactgaattagtacctactacaaatgccagaaaattttaccaacatgctctacatctactggatgactggcaaaatgcaacagacagcttagatttagctgaagaacggccacgtactacagtgagaataggtgcatcgcagacctcagcaaccgttctactgcccaagatttttgcacaaataaaaaaagatgaatttaacaccattgatttcaaaattgaaatgcataattctgaagaaatcctggctggtgttttaaatcatcaatttgattttggcataattgaaaaaccgatcacacatgattttattactcgtgatgcgatagccgtcgatcaacttgttttggctggtaatctggacagcactgtttggttggttcgggaaaaaggttctggggtgtatcattacacacaacaatactttaaacagcataacattgtaccagatcatttcttaactattgcaaataatgatattattgtaaaaatgctggcacaaaatgttggtaaatctattgttagtattcaagctttaccagaatctgttccttataagaaactagatgacgcgtttaaccgtcaattttatattattcaccatgaacatagtaatcagagtgctatcaaaaatgagatcgcacgctttattcagattgccagaaatttataagaaaataacttcatcgttttcaaaacctttaattcttgccaaactttcaacacgtaccccgcgctcatctagaatttgacggcctttttgaaaagtcttttctatgacaaccccaaccccaacaacattagcatttgcatcgttggcgatcttaagcagcccctcgacagcctgtccattagctaagaaatcatcgattattaagatattttcagcggcacttaggaagcgatgatcaatcataatatgattcgtcgtttgctttgtaaatgaatacacatctgcagtccaaacattctctggcaatgttaaagatttattttttcgtgcgaatacaactggcacatgaagtgccagacctgcaaaaactgccggagctattccagatgattcaaccgttacgatcttatcaattttctcatcagaaaatattgttgcaaattcttcacccatggcttgcataagttctgggtcaacttgatgatttaaaaaagagtccacttttaacacatctttacccaaaacacgaccatcttttttaattctttgctctaatattttcatcattcatttcctttttcatttactgccaccattgacaaccactacctttttaatttgagacgtttttagaaaaaaatggcgacaaactatcgtaatcaatacaaaatttgaaataatcattattttcgaaaaaaaccagaaatcatcatcaaaatgctaaccaacgccattaatataagggtaataacaatcgttacccaccaaccactttgtgcatcagcaaacggcaaccacttcacattttcaccataaaacccacttacaatagttgggactgtcaaaacaattgagtaaacagttaataccttcatcgtccaattcaaatcacgattactgagattgcccatcgcgtcactaactgaattaatcacctctagtgccaagttagccattcgcttagcttgttcaacttcaactcttacatcatcaatatgttctagttcaaactctttcaataatgttttaaaatctgttcgaaagctatctagcatcacatgattattggccagtgaattttgaatataaatcatttgtgtttttaaatataataactcattcatttggtgtgtcgtttgtttttgttgaccaaattgtgcttgaatgacacgccgttttttattaatttctgttatttcgtcaacatactttatcattaaagaatataatcctgtcatgataaaatcaaatgcactaatttcgtcctcttgcgctcgtatttgttgattttgcggatctaatataatcggtttgatgtaatctgtaggctcatgcgtaaatgtatagacatcattatgagcaaataaaataccaattggcctcgtctctacattgttgtcttgatgtacaatcacgtcaataaccatcaaagtttcgtccgcatgccgatcatattccatgcgcacactctcattatgatcaacagcatatcctatcatttcattggttaagtggtgctctttgactaagctttcatgttcttcaactgtcaaatttgaaacgtgataccatgtaaagttttttacgttcttaactatctcaatcattttctgccatccctataagtcagattttgtggctttgcaaacactgattttccaacagctaaaaacccttctcgttcgtaaaaacgttgcgcagcaacattagctgtaaccacttttaattctaacgcttgcgttacttgattgcgtgcccaatcaagtaattttgcaccaatgccacaaccattccagccttctttaataaatagcagatgtaaaaaactatcacgctctgataaggatgcaaatcctacaatttcttgattaataatagcgacctcgaccacctcaccatgagaaactctagcaaaatcctctaatttaggatgtttaacccaagaaaaattatgttgtcgagcacctaaataaatacgcgcaagtgcctctgaatcgtcaggttgcattgcgcgtagtactagatttttcgttgatttagtttgcaaaaaattttttggactggtcattaacattctcttttgattgcttatctgagttccagaatggcacatagattttaccaagtacatgcttcttttcaacgtaaccaaacatacgactgtcatttgaaaccgatcggtggtcgcctagtacaaagtatgaattctttggtacaactgttgtgttacgatctttcttttgccaaaaatctcgagatgatagcgtttttaacgtccaatcaccccaagtgccccctgattgttgctctaatccaatgtaatcctgattaacttttttaccattaacatatagattcgcacctttatgtgatactatatcaccgccaacagcaattacgcgcttcacataatccttgtgcccagatttaatttgtggatcctcattggttgcgtcaaaaactatgacatccccacgtttcacagtagatattttgctctcaacaactaattcgccattgtctaaattgggattcattgacggtccgtcaactgtcaccaaagtaaacagaaatgtgcggataatcaaagcaatgaaaagaccaatgacaatgggtattacccagttttttataaagttcatatcctatctgcccctctaacattaaataatattatatcagtttttaaaaaatatttatacaaaaaaagctggaaacagtgttataacaacattgtttccagctaataatatcattttttaccgcttacggcgttttgcttttctgattttacgttgtttttctttttcaagttgcgctgctgcttcgcgttcacgtcgtattttgaaaggattttgcaagaaaaatgtctgtacagtttggaaagcatttcccacaacccaatacagtgacaaagcactcggaacggctagagcagagaaaaagatgatcacagggaaaatgtatggcatagccttagtcataccattttgatcggggttagattgcattgaaagccatgatgatgcaaacgtgaacaatgcggccaacaccggtaaaataaagtacggatcattacttcccaattgtagccacagaaactttcccgatcttagaacaggtgaattccaaattgactgatacagtgcaattaaaataggcatttgcacaattaaaggtaacattgaagcaaatggatttacgccagcatccttataaagtgcttgttgctctgccatcattaactgacgactttcagtatccttacctggatactttgcttgtagttcttttaaagccggctgaaccacttgcattttcatcattgattgcacttggtataccattagtggcaagatcaagaagcgaataaaaatagtaaacaggataatacccataccatagttattgccaaaccaacttgaagcacccaaaatagctcttgtaaacaccgcgacaatcgcactccagaaactatgtgatgtcacatgtccatcatacgacaatccggacacaatgattaagaccaacgctactcctgccataatcaaaggtaacggtccaattctcttcaaaatattctcaaatcgcttcattcgttctcttctttcaatatcttagccaactttaacacatgaatcatttgatttttcaaaaatttttgacttctatgtgctgcagcagggcgtgcaatgactaataaatccaactcttgaggtaattcaggtttcaattctaacaagctttgacggatacgacgtttaacccaaacccgctcatgtgctttacctacttttttactaaccgaaagcccaacacgaaaatgtttttgctctggtttatccatttgataaacaataaaatacttattagctacagaacggtgtttattaaaaacatgttgaaattcttctggtttttttatgcggaatgtttttctcatgaaattactccctatttatgtacgtagccgtatcaacatgcctaaatggttactaaaatgttcatcttcacgataaataatacattatttatttcttcatgtactaaataaaaaagccactgcatagcagcgaccttgttaggcagatagaaccttgcggccctttgcacgacggcgagccaaaactttacgaccgttgctcgtgctcatacgcttacggaatccgtgtacgcgttcacgatgacgcttttttggttggtatgtacgcttcatgtgtgttcacctccattcacgatttttacctgcaaaaactttgcaattcgagtttaatcatatcatgaaatcaaccccagcacaagcgtactagattttttttcaaatacttaactattatacgctctttgctatgttaatagcaatataatcctcatctcagcattgacaatcaaacttttgttacaataaattttagaaatatacttatatattagtttaaaattttttaatcatacttgctcaaatattatcaatatactctaaggactcttcttatgcgtaaattaacacatcctaaccacaattgtatttcagaaactgttctatttagtcagcttccccaagatgaactaaatatgatcagcaaacaaatcaattacattgaatacgcgcctggggaaaccatttttgatgtagaggatgattctgatcgactactattagtacatcaaggcaaactaaagatcagccaaacctccagcaatggaaaagaacaaacgctttatttcttaaatgaaggtgacattgatggagaagaatctttaattataggttcacgccacgcagtaacgtgtgtcgctgtggtaaaatctcgcatttgtgaaattcgcagaagcgattttatgaccttaacaaaacgacaaccaaccattggtctatcattagccatatctattgctgaaaagatgcagaaattacagacacaacaagctaatcttttaactggatctgtggaagatagattattgaagtttttaaaggatactgccgaagaaacagatagtttaagttttgaactacctatgtcaaaaaaagaactagcagcatatctcggcactattcctgctaccctgagtcgaaactttacaaaacttgaagaaaaaagaattatcagcaatagctccaaaggtaaaatcgtgttaaatatcacaaaaatagataatccttgacttaggtcaattacttatgtgattgtttgagcttataattgatgtacagattacaattactaatcggaggacatacatcatgaaaataggtataattggtgctacacatgctggcgtatatgcagccaaacaaatcaaatcggagcatcccgaggcagaagtaactgtatttgaaaaaaatactactgtttcatttttgtcgtgcggcatagctttgtggattggtgatcatgtttctgatcctgaaaaaatgttctacgaaactcctgaatcaatgcgcaaccaaggtattaccatgttgatggcgcaccaagttaatcaggctgacctaaaatctaaaacattaacagtaactaatttagatacagaagaggttacaacacaacaatttgacaaaatagttatcacaactggttcaaagcccgttattccaaatattcctgggattgacagtaatcgtgtgtatttctgtaaatcttgggatgacgctacgcgtatcaaaagcgttgccaaagatctcaagcgtgtagctgtcattggcgctggttacattggggctgagttagctgaacaactttctgttactggaaaacaagtgacgttaattgatggtgctgaccgtgtgttggcaaaaaactttggtccggctttcaccgagcgtattcaaaaagagtacgaaaaaaacaatgttgatgtggttctcaaccagtttgtatctaaattcgaaaacacgcctaacggtatcaaaataaccacaccaaatggctcatacgaagctgatattgcaatactaggcattggattcttaccaaacaccgatttattcagtggtcaacttgagacactcccaaatggtgcgataattgttaacgattatatgcaaactagtgaagacaacgtctatgccgctggagatgccagtactgtctttttcaatccaacccaagccattgattacatccccttggctacaaacgctatccgccaaggtatactagtcggtaaaaacattgttgaaccaacaactcgttacctcggaacacaagctacttccgcagtcgaactatatgaacaggccatggttgctaccggattgaatagtgcgactgctaaagaaaaaggtcttgatgtcattgaaacagttatcgaaagtgattatcgtcccgactttatgctaagtacaacttctgttcttagttcattaacttgggaaaaagatactggccgaattgttggcggttcgtttatgtctcaacatgatgtgtcgcaatctgccaatctcgtttccatagccattcaaaaacaaatgacaattgatgaattagcaatgtctgactttttcttccaacccaactttagtcaaccaattaactacattcctgaggttgctcttgccgctgtcgctgagaaacaggctttgacattagcttattgatgaatttattgaattaatgaatacaaataaaacacgacttcctatgacgagtcgtgttttattcttgtagcgtgatttttatatttaaattattagtctttgtcacctaagattgaaaccatagaaacagtagaattccatcactgtcaatctttgaccaaggttctttttaatttcaaaggagccctagattgtaaaggagcccaaatagccattcatcacgatgtaattttttcatcaatattctgccatcttttgacaaattatggttgagagatagttttcgaagttcattagtcatacttgttaattctctgtattctgatacttttggattattcaactttttagttgtatcagagattaatttttcttcctcacgatttaaattggggtgtttttctaaaaattttaataaatatttttgtttatccgttttgaacatggttttcattttaatttttacgttcgttaattgttatcaagtttaaaagtatgcatattatttaaacatatgtggtaagcgtccgtcaattttttgctaaattaactaatataagccatttaacaaataaaaatagcccagtgaaaatgattcgggtcaatttcactgaactatttttgtttactttatacagtctatgccacaaaaagactattcaaatgaagcccacaattttacaatcgcttgtacaccttcatccccatgttcttgactcaatcgctcaaatagttgctcggcaagtttggtattgggcaaatctatatccatttccttagcagcgtctaacgctattcgtaagtcttttagtaagtgcttgacataaaacccaggcgcataatcaccttggaaaatacgtggtatataattatcgaccgaccatgatcctgcagcgcctttacgccaaacattgtaggcactctctaaatcaaggccagctgcttttgcataaactaaggattctgccattgtaataacggttgctgcaacaccaatattgttgctcatcttcatgtgttgtcccttgcccgctgaaccagcaaaaacaatttgctgtccaataacgcttaatacaggtttaatctcatcaagaacttgttgttcgccaccaaccataatcgctaatgtcccattcttagcaccaatgtcaccacctgaaactggcgcatccaacactttgaatcctaaatcagcaccagtttgagccaattgttcagccaaacgtggtgttgaagttgtcatatcaaccaaaattgaaccttctttagcaccagcaaaaacaccatcttcactcgtccacacttcttcaacatcttttggataaccaaccatcgtaaaagtaatatccgagtactgtgcaactttggccggtgtatctcgccagatagcaccattgttgagcactgtatttgctttgctatgggtacgattgaaaacggatacctcatagcccgcttgcaataaattattaattattcctgtgcccattacgccagtaccaataaatccgatattcatacttcatcctccttaatttaaaagcaccacacccatgtgcaatgcttttaaatagctattttgtagtaatcagtttttgaatagtttttaaaacaccactatgattattatccgacaatgcaacattaaattgaccaataatgtcagcatccggcattttatatggcagcccaactgcgtttaacatttccaaatcattaccaccgtcaccaaaagcaacagcatgagacaagtcaagagcataactttcagctaacatttttaatccttcggccttattgacataggcaggaacaatatcaatagccccagtacctgtttccgtaatatgcacatcatcaccaaagaatgcaagggcatcatcataaaaccttttttcgtcaaagtttgtccaactcatagtgactttgtagattggttcgttaatttcacgcacgtcaccgaaacttttaacgtacttaaagtatttaaaataacgcttgttacttgccatatcgaaatccaaaggcaaataagcggtctcatctgttgaaaaaaccaagccacggtctggacgcatactatagttattcaagaattgttgaattttacgcaaagttaccggggggagaactttcgagaacaacacggtgccatcgcttttcaccacacgagccccgttattggtgacaaaattcaagggctcattaagaaaatctttaaataagatattaatgcgttcttgatgaacacctgtggctatcgtaaattgaatatgcttcttatttaattcacgcaatacattacgaaacaatgcttgatcaaacttcttatcgtccgtcaaaaacgtaccgtctaaatccgttgctatcagctgaatggtcaatgttggaaagttcctttacctgtctactagtctatatgctattcattctaccttgataaactgggtatagcaaatctgtctttttgtttcacgtgaaacaatcaagattatgccaaaatctgttgtgcaatccatgccccttcgcgcaaaacaaccgtattaacaccagggcgtggaataactgtcccgaaccattttttgccttcaagagggataccataaatatataagttatgcatgcgctcccctttggaattaacaacctcaaaggtacgatgatccgcatcagctgaacccaatttataggttgatccatcgttacgtgtccaaatagcagctgccaaaatgcccttctctcgcagactagcaatcaatgggtttgttgataggtcaatgtttgtcatgccaacacgcgcttcaactaatgcattacctttcacttcgtttccccgagcatcacgagcaacaaagttacctgattcagtggtgacctgtatgttggcagccatgacttccacaattccagctttaatcaaggcacgtaactgctcgacacgttccaagggtggtccaacagataccatagcgtctaacggtctgaatttactcaaaaatatttcatattcatctgcagagaaataatcatgctcaactacaaaacgaacccgatcgcgtaaatcacgtaaaatatcgaaagcacctgcaaaaggcgctattttatttcctaagcgagcatcttgaatgtctttttctaagtagtctaataaccactccgtataatcagcactcttaggtaaatactttgccggttgacgtatagcctcgatatcaaaaggtggctcatcaatcaaaccaactgattctgctgttgcatttaaatcagcactcgttagtaacgcctgcttcaaatcctgcgcctgatcgtatgtcaaattgctagttggactgtcgattctattcagtaagtgtttataggtcaactccttaacaagcaacttttcaaaatcatcgtacttgatttgtccatgtccagctgcgcgcaaagcttctaaggctggtagtgtgaaaaatattggctcataaacttcacttgtctctttttcattgataccacgcgcatgcaatggcacgccactacgagacccggcaataatatgcggttctcgtccagatgaatgataggttaaatcaccatctgtttcgcgttcaaagtaccccccttttccaattgacaatcctgccatataatcgaaaaagcttagcccgaggccacgaatgatgactttatcttcttgcgaaaatacggaaagattggcctcagatggatgcgtaggcggcaaatactttagactattttcgtctgcaaatgacttaaacttagcttcctcagccgttaaatcattatttgaatgtcctaaggccatcacgacttgattggctaaaatttgggtcccatctgtcaaaactacttggtaatttgtaccaatttgagtaaggttttctacgctttgctgcgtaaaggttaatgtttgattgctacggactctctttttcagccattcaaaataccaagccgcgtaaatgcccatcatgcctctcgtagcaaaatcactaggtgatgttaaatgttgtatttcggctgtataggaatcatcaaactctgaatgcttctccaaaaaagtgcgcgcgtctgactttaaccactgaaacaaagttggtccatgtagtggtttaccaccatgttcaattgaatcatcagtaaataacgtaatttgatcaatcactgtattcattagaaacaatttattttgtggaatggatgggtcccagactcgtccaccaatgacgtgtggatcaaatatttgaacatcgagttgaacatcgtcatccgctaaattaatcagtcgctcagccaccgctaaaccacgcggaccggcaccaatgattgctacttgcattatttatcttctccagaacgtctaatttattaacgcttttatattattattagtttcccattattatagttgtttataaaaatattttcaaaatgctcaataaatatcataggtaccttaaaacacaaaaacgacagccattaggctgacgttattagtatattcattcatttgcaactagttatttatcaatgtcataagaatcggaaccactaccaaactaagaattgttgattcagttaccataattgctgcataatcagcatccgcaccatacaaactagccactactggcgcatttgtcataactggcatagctgactgtaagataaatacttgtttcattagatgcggcacatcagccttccataggaggaaaaacatgacaattggggccaaaataaaacgaccaaataatatgcctaagctatatttattgaactccatatttctcaagcctgcgcgctgcacagcaataccaataaagaacattgatagtggcacagttaagttacctatgtactgtaaatcagaaaccacaaatgttggcagtttaacatctgtccaaacaaagatgattcctaagataaagccaagcaacggtggtgaaaaaacctttgatagcgtcgccctgatatcaaatttccacgctccttccccatcacgctggatgagataagtacccaatgtccagaaaaaagtcgtgttcaccatataataaactaacacatacggtagacttttaacaccaaacaaagccatatttattggtaagccgacaaatacagtatttgaattgaaaaacattgattgaaaaaggccacggcgattttttcgaatacctaaagctcgtgcaaatccaaccgaaattgcaaataaaactagcatcgagataattggaaatttaatttcaggtaataaacgtatcagttcgcctttagtgaaatcatgcgttatcgtattcaccatgtacattggcaacgcaacctgcgtcacgatacgtgcaataatctggccacttttatctgtgaaccactttgcacttgccaatccataaccaatggcaaccattactaggatcaccaagacaccctgtatactctgtaaaaatacgctcaaaacactgccccatttatgtgagaaattttaaaattattcacataacatcatatcatttactagttttgtttgcaccatctatataaaaatatgcataaaaccgttgatgaacatacgaacgtgttaaattattttttttcaggaaaaaaatcgatttctcgcccatttaagtcctgtacttcacgataattatttggataatcagcatgtaaaaatgctttatcttgctttgatatttgtattgctgacgtcaaaacgagccagttaatattttgccctaatggcggtgttgtcaacgatcctgtatatcgataataactacgattgtcaggaattaacttcattaacccttctgcgttaacatgttcatcataaatgttttgcacttcgataccgttatcattatttgctgtttctccaaaaactgctaacactaacgtttgattatcacgttgaaaaacaaaatgaatctcagcatcgtacctcttaccgtctacgagatgttctgccccatcatgaaaatgaaatctttctaatgcccataccgtcccatcaacacgcaaattaccttgaactaaaaactgttctcctataattcgatcgtcagactggactcgatcctcaaaatgaataatcaactgactgttttcttgttgttgaatgcttgtcaacggaatatcaatcggtgattgataaatcgtgtcatcggcctttcgccaatcctcttgttctctataatctaagtgcttcatccgggtacctcttaaatttcttactatcgtatttatatatagtaaagcaacaacaaagaaagttcccacaatatgctcacaatgcaccatcaatttttgctccccagcatcaattggttcatttattctaacacgttttattttgtgaaaataattattaatgcattttggttgactatcctaacaaaaacagctcaaaagctatgataattaaggttttttcaaaaatatttatcaactttttagaggaaaaacagaaaataaaatagctccttaataaattctttaacattcacaatgttataaaaacttatcctctacctgtttactcacggtgttttttagctttttactaacatgctctttcacaagttatccacatatccacaagttgtgaactcacccctgtggataatgtttataaacagcctcaattattgtcctttcgcccttttgcttgtgtacaacaatgttcatttgtggataacccacacatttgttcgtcttaatatcaacaacccctctttttcattgtccacaactgttgatattctctaaagttgtcgtttgcctgtggaaaactatttttcttattgttataattatctttgctacttcttctatattagaaaagtcgtcggttcaatccataatcttcgttaaatactatcaacgtaagatcgtcatttcattctgacttgaaccatatttaggagagataatcgtgacaaaaccaataaccaaagaagaattatggtcaaaagtgcaagccgaattttttaccaagctcggtcgtgttactttttccacctatatagaaccgctaaaaccgctgacactaggggataccagtttaacattagcagtaccaagtgatatggcacaagatatcattgatcaatgggatagtgaatactccatggattttgtacaatttgccatgtcgattgctgatggttttattaagcccgacttgcaagtggccgaagcaaagcctaccactataccaactttttcagataatttatcatttacgcgcgaatctgacttaaatccagattttacttttgaaaaatttgttatcggttcaggaaacgaaaatgcctatgctgtcgcgcgtgcagttgctgatgaacctggacaagtatacaatccttatttaatttatggtggggttggtcttgggaaaacacatttgatgcaagctatcggcaacgcgtatgctgtgtcgacgccaagcgcacacatcaaatacgctacagctgaagattttttgaacgattttactgaatctttgcgcgcaggggatggcgctacagcagcttttaagcaagaatatcgttctgttgacctcttacttgttgatgacatccaattttggtctggaaaagaaaaagttcaagaagaatttttcaatacttttaacgttttaactaaaaatggtaaacaaatcgttatgacttcagataaattaccaacagagattgttgatctacaaacacgattaacatcacgttttgaagccggcattatgatggatattcaaaaacctgatttaccgacaagagtagctattctacaaaatttgtctgaatctgatggtttagatattcctaatgatgtgttagaactgattgccgaaaaaattgattccaatgtgcgtagcttagaaggggcgtttcataagtttgaagccagcttgcgatatatgaataaaccggctacaaaagagactgctcaacaaatattaggtgatttaaatattaatcaaggcttcaagatcactgttgagcgcattcaacaggttgtggcagattattatatgcaaactattgatgatcttaaaagttcaagtcgcaaaaaagatcttgtcactgcacggcatgttgctatgtatctaacaagaacgctaacaaatgaaagtttgcctgacattggccgttcatttggtgggcgagatcattcttcggtactacatgccacgaccaaaataactgaaaaatcagagagcgattcgcgtacaaaagaaatgttggacgccctaactgatgaaattaaacatggcaaataactctaagcattgctcataaaaacgtatgtttataaagttgtaaaaatagggtagttaccaacagcgttgtgaacaactacttataaacgttctgttagtcacaggagacttttccacaacatcaacaccccttattattactactacatattttttatataattattaatataactatcacttatttgcttaatttaaaaaggagtaacatcatgcaatttacaattaaccgttcagcctttattaaagccctcaatgatgtatcacgtgctatttcatcacgaacaactattccaattttgactaatatcaaattagttttaaatgatgaagaattagtccttactggttcaaatgcagatatttctattgaaacaactgtgccacaatcagataccagtgcccaattaattatcacaactcctggtggcattaccttaccggcaactttctttattaatattgttaagcgtcttcctaatgatgcaatgactcttaatgttgagggcttacgagctactattacatctggtgcctcatcatttacaattaatggacaagacgtacaaaactacccacaattaccagaaatggatgatgtgcaaagtttgagtgtttctgctgcgcaacttgtcgatattatttcgcaaacaaaaatttcagcttctacgcaagaaagtcgaccaattttaactgggatacatctacaattaacaggaaatagcgtgaaggcagttacaactgattctcatcgcttatcccaacgcattgttcagctaacaggaactgacgccaacaatgttgatgcaaatgtaattattccagcaaaatcttttaatgaattacaagcattactcgagggtcaagatcgtgtggaaatcaagttttctacaaaccaggcggtgtttgatttaggacgtacaacattttattcacgtttactagagggaaactatcctgagacagatcgtttgattcccacggagagcacgacacaaatcacaattgaggcaagctcattactgggtgcaattgatcgagcaagcttactgagtcacgaaagtcggaataacgttgttcaattgtcattaaaagcagggcgtgcagtgttaaccggtacgtctcaagaagttgggcaggtgaccgaagagttgaatgccaatagcattgaaggggaggacttagaaatctctttcaatccggattacgttcgtgatgctttgcgtatttttaatggcaagcgtgtagatgttaaatttacaagtaatttacgtccgtttactttgacacctgaaggagagacggacaataaacaattacaactcataacaccagtccgcacgttttaaattgaaaaatatgtcatttgttcaaatacttgaaaataaacccgtttaaacaaaaataaacaaaacacactaacgaggcctagaattgcttatatacaattttaggcctcgtttttgagcttttagggtttaaaaatggtataatactatagtaactaccgtgaccattaactcacaaagagaaagcgatatatgacaaccagcgtacgtatcacaactgaatacattactttgacacaattattaaaagaagagaacattatttcatcaggcggccaggccaaatattatttaatggattttccggtgttactcaacggagaaacagaaaatcgtcgcggtaaaaagttatacgatcatgatgagattgttattgatggcgaaacatacacaattgaattagcagagaatgctgaagagttgatagcagaagctgagacgcaaagagctgaacgtgctatgaacgctaaaaaaaccgtccgtgatgatcgtattaaggcacaaaaggcagctgcagccaaagcccgtaaggaagctagatttgctgaattacgcaaaaaaaatcgtactcgtgctggtggatttggtcgctcgacaaacaaacctaaaggacccggttcgtggaactcgaatcgttaaagctcgatcattatcgtaattattcagatttaacgctggaattcagctcgggtgtgaatgtttttcttggtgaaaatgcgcaaggaaaaacaaacttattagaaagtatttatgtattggcacttgcaaggtcacatagaaccagtagtgacaaagacttggtccaatggcaagcaaaagaagcaactatcagtggccgggttaaacgttctattagtgagaccccgctgtcgctccatttttctaataagggtaaaaaagcacgggttaatcatcttgaacaatcaaagctgtcgcattatatcgggcaactcaatgtcattttgtttgcaccagaagatcttgagctggttaaaggggcgccaagcgtacgtcgccgttttattgacatggagtttggccaaatgaaccccttgtatttgtataatacgacacaatacaagcggattttaaaagaaagaaatgcttatcttaagcgtttgcaacttaaacagacaacggacacagtattcttggatgtattgagtgaacaattggttgatgtaggttcacaaattttaattgcacgtcaagaatttttgaacaaattagaactggctgcacaaccaattcacgctgaaatatctgatcagcgtgaagctttgaaattacgatatatgagttcggttgattttgcttcagatgctagtcttgaagaggtgaaatcggtattcgctgatgcattgtcacgtcagcgttcacgtgaaattatgcaaggatcgacaatggttggccctcatcgcgacgaattacaatttgatgttaatgggaataatgttgctgtttttggttcacaaggacagcagcgaacaacggcgttggctattaaattagccgaaattgatttaatgcaacaagaaactggggagtatccagtattgcttctcgatgatgtacttagtgaacttgatgccagtcggcagacacatttattattggcaattcaagataaggtgcaaacatttatcactgcaccaacactcagcgatattgcacggcaactcattcgaaaaccacgtgtgtttcatgtgaaacaaggagtgattacactcgaaaacgacacataggttaaatcaatgaattgattttgctatgtgatgataatagatagtacataaaggatacaaaatggcagaaaataacgaaaatatagatcaagaattagaatcagttgatgatattattactgatgacgaagaaatccgacacgctagcacggttgatgcgaaggccggtgattataatgctgatcaaattcaagtattggaaggcttagaggctgttcgtaagcgtcccggaatgtatataggaacgactacagcccaaggtttgcatcatttggtgtgggagattgtcgacaacggtattgatgaagcgttggcaggatttgcttcccacataacggtaacaatcgaaaaagataattcaattactgtaacagatgatggacgaggtattccggttgatatccaaacaaaaacagggaaacccgcgctagagactgtgtttaccgtgcttcacgctggtggaaagtttggtggcggcgggtataaagtatctggtggattgcatggtgttggtgcttctgttgttaatgcgttgtcaaccgacttagatgttaaagtggttcgtgataataaagtttactatatggacttcaaagttggtcgtgttcacacaactatgagaaccttagacgaggaaccaacgattgaacgcggcacaattgttcactttaaacctgatactgatatttttcgcgagacaacaacttataattacaagactttgttgacacgtgtgcgcgagttggcctttttaaataaaggattacgtatttcgattgctgacaaacgtttagaagaaccaatcaaagagagcttccattttgaaggtggtattaaagaatatgttcaatacctaaacgaagataagcaagttatttttcctgaaccggtttatgttgagggtgaggaaaatggaattgtcgttgaagctgctttacaatacacaactgacataaaagacagtttgcgtacttttgcaaacaatattaatacttatgaaggcggaacgcatgaaaccggctttaaaacagcattgacacgtgttattaatgattatgcacgtaaaagtggtcaaattaaagacggtgcggaaagtttgactggtgaagatgttcgtgaaggaatgacagcgattgtttctatcaagcatccagatccacaatttgagggacaaactaagaccaaactaggcaattctgatgcgcgtcaagccacagatcgcatgttctcagaaacatttagtcgtttcatgatggaaaacccaaatgttgctaaacaaattgttgaaaaaggtgtcttggctcaaaaagcacgtttagcagctaaacgtgctcgcgaaatgacgcgtaaacaatctggtttggagattggtaatctacccggaaagttggcagataacacatcaaatgaccctgccatttcagaattgttcatcgttgagggtgactctgccggtggttctgctaagcaaggacgaaaccgtgtaacacaagctattttgccaattcgtggtaaaattttgaacgtggggaaagcttcactggaacgtgttttggctaacgaagaaattcgctcgctctttacagctatgggcactggctttggggatgattttaatgttgaaaaagctaactatcataaagttattattatgactgatgcggatgttgatggcgcacatattcgtacgttacttttgacattattttatcgctatatgcgacctttggttgatgctggctatatttatattgctcagccacctttgtatggcgttgctttaggcaacaacaaatcaatgacttacttggattctgatgaagaacttgagtcatatttgtcgcaattgccatccaatgttaagccaaaagtgcaacgatacaagggacttggagaaatggattatgatcaattagctgatacgaccatggatgctcagaaccgtcgtttattacgtgttgatccagctgatgctgaagaagctgaagcagttattgacatgttgatgggtggcgatgtgcctccacgtcgaaagtttattgaagataatgcagtctttgttgaaaatttggatatttaatccaagtgtgttttagtattgaatttaaaaacacaatataaaagtcataaaatatttgcgaggagtaaataagtaatgtctgagttaaacgacagccgtattaaaaatgcgaatttgtcagaacaaatgaaaacgtcattcttgtcatatgccatgtctgttattgtggcacgtgcactgccagatgtgcgcgatggcatgaagccggtacatcgacgaattctgtattcaatgattgaacagggaaacacaccagataagccacacaaaaagtcggctcgtattgttggggatgtaatgggtaaatatcacccccacggagattctgcaatttatgagtcaatggtccggatggcacaacctttttcataccgacacatgttaattgacggtcacggaaactttggttctgtcgatggcgacggtgctgctgctatgcggtatacggaagctcgtttgagtaaagtcgccatggaaatggttcgtgatttaaacaaagatacagttaattttattcccaactatgatggtgaggaacgcgaaccggaagtattaccagcacgttttccaaatttgttggttaacggggccaccggaattgctgttggaatgacaacgaacattccaacgcataaccttgctgaagtgatttctgcgcttcatattttgatgaataatccagaggctaccacagccgacctgatggaagcattacctggacccgattttcccactggtggtattgttatgggaaagtcaggtattcgtcgtgcatatgaaactggacgtggcactgtaactgtacgtgcaaaagtagatattgagcaacttaaatcaggtaaagagcagattgttgtaactgagctaccttacgccgttaacaaggcgcgtttaattgagcgtatatctgaattagcacgtgataaaaagatagaaggcatcacaggaattcgcgatgaatccgatcgtgaaggcttacgaatttctattgatgttcgtcgcgatgcttcggcaagtgtcattttaaataatctatataagcaaacattattgcagactagttttagctttaatatgttggcgattgatcacggtgcgcctaagacaatgagtttgaaagagatacttgttgcttatctggcacatcaacgtgaagttatccgtcgtcgtacagtatttgaattacaaaaggcacaagcgcgcgcacatattttagaaggtttacgcattgcgcttgatcatatagacgaaattatcacaattatccgttcgtcaaagacctctgaggaggctaaaactcgtttaattaatggttatgctttatctgataaacaagcacaagctatcttggacatgcgtttggttcgtttgactggcttggaacgtgacaagattgaagaagaatatcaaaaacttgttgctctgattgctgatttgaaagatattttggcgcatgaagaacgtgttgatgaaattatttataatgagctactagaaatccaaacaaagtttggtgacaagcgtcgcacagaattgcaggttggtgacgtcctaagtattgaagatgaagatttgattgaagaagaagatgtaatcgtaacattgactaatagtggttacatcaaacgcgttgcaactggagagtttaaggcacaaaatcgaggtggtcgtggtgttcagggtatgaatgttcatgatgaagattttgttgaccagatgatctctacatcaacgcatgatactttgttgttctttactaataagggtaaagtctaccgtatgaaaggctatgaagtaccagaatatggtcgccaagcgaagggaatcccagttgttaatcttttgaattttgaaggaaatgaaaaaattcaaaccgttatcaatgttcgtggggaagccggtgaaagcaatgattacctattctttgtaactcgtttgggtgttgtcaagcgtacagcggtaaaggaatttgcaaatattcgtacgaatggactaaaagccttaactttgcatgatgatgatgaagtactatctgttcaaattactgatggtacgcaaaatattattattgcgacacacaatggttattcagttagttttgctgaaaacgatgtacgtgttatgggacgttcagctgctggagtccgtggtattcgccttcgcgaaggggatctagtggttggttctgacgtgttggaaaaagatcataatgttttgatcatcacggaaaaaggttacggaaagcaaacaccagtgagcgaatatccaatcaagggtcgtggcggtaaaggaattaaaacggcaaatatcaccgagaaaaatggtccccttgctggaatgactattgtcagtggccaagaagatattatggttacgacgacacaaggtgtaatgattcgttttaatgttgattctgtcagtcagacaggacgtgcaacactgggtgtgcgtttgattcgcttagaaggtaatgccaaagtggctacgttagcaaaagtagaacacgaggaagtgctagaggatgtttcacgtgaaacatctgataaggcaccgttggatgagcaacaaattgaccaagtttcagaactattagatcgtgcacaagaagatactgataaataacaaaaaataaaccaacaggacgttagtagcctgttggtttatttttttataaaagatagaacaattgaaaacttggtagaaaacaaatagtataacaactaattttcataatgttataatacattaaaattaaggagtagtgattatgagcatatacgattattttgcaaccttagaaaacggagaaacttattcacttaataagctagccaatcatccagtagtgattgttaatactgctacgaagtgcggctatgcaccacaatttggtgagttagaaaaattatataagaagtataaagataagggactagtaattttaggctttccatctaatcaattcaaacaagagttagaaaccgcatcccaagcagcccaagcatgtcaacttacttatggtgtaacttttccaatgcatcaactagttgccgtgaatggtaaaaacacagatcctttgtttaaatatttgaaagagaattcaaaaggaatgctgggtagtagcacaatcaaatggaattttacaaagtttttagtggataaggagggaaacgtcgtaaaacgctatgccccaaaaacagaacccaaggatcttgaagaagatattgaagatgttttatgagtgccacgcattccggtaaaaaccttaagtacgtattgttggtgtcttaaactggatcaaatgatgttggaatttacgtgtcaccggcaacagtgtaccatctgttaattcaattattttttctgactttaagtattgcttgataaagtcacgattaatacaaaatgatgcatgaatctgtatgaagttttcatggcttgaagcaatagttttgattgtatttcgaattttgcttacaccattctttgtgaaaacattgatataatgtgtacccttattactggagacataagaaaggtggttgaggtcgaattggacgaggtgtgcaccattgcgtatagtaatcaggttaggagattttttatcgtatcgtttaagtacttgatcagctgtgtaaatagccgacttgagttgttgtgcgaacgcagactcaggttgtgatttgtcaataaagtccaatgcactgatgtgatgttgaaatgtgtgccatgatagttcacaatgagttgtgacaataataatcggtgaaataatatcattcttgcgaattagttgcgcagtttgaagacctgcataaatgacgtctttaatttcaagatccagtaaaataatcttcggggttttatcttttagcactgcagataataaattggcaggcgaagtgaacgtgtgaatatgttgtatatactgtttaatacgcttttgttgtgtaatgtcgtcttctagcagataaatcattgtgaagttctccgatagtaagcgtctgcgtaaaattctgattcatcaaagtagcatgcatcgaaatcgtaggcatccgcgccatgtactgttctacaaaggttaatccaataccagagtgacccggtttcgttgagaaaccatttttgttcatgtttgaaagggccacattctgattaatggtatttgtaatactgacaatatgataatcgttatctgacaaaatagataaaatgaccttcctttcgatgctgtttatggctccctcaatggcattatcaagcaaaataccaatagttcgataaagatctagcgtcacagtcatattgaacttttctgcaatatcgactttaaaaaatagaccactatcaatagcatattgatttttgacaacgagtaaactacgtaggtttaaatcggtgatcaattgaagatttaaagttggtgaaagaggtaaagcactagtactttctgataagaaagaatgatagacttcttctatttcacataaatttttggtatcaatcgctagagctaaactggcaagtatatttttatagtcatgttgaaaatgtctgtaggacgaacaaatttgctccagtttcgtaacatatgtctgtgttgcgcgactttcatattcgtgttgtgtgcgtaattgctgaaaatacctgcagagggggtagatcatgataattagtaaaaaaataaatgttaattcaactaaccagatagaatctaagaacatattgataggtatcgtaattgataaattcagagtagggttcattttgaaagtctttcgtttgtataataatagaggattatgtaaataaattacaaatactttgctaatcgtataatacgaaataaattttcgaaaagcttattttgaattcatagcgttatcggtttaattgctaattaatccatgagttttaaaattggatacaattagggtgagaattatattttcttaattcggaaaggaattggtgacagcatatgtgagcattctgctgactgtttacatttgttaggtcattatttatagaatgatttttttcttaaatgcaactatgcaaccacagaaatcaggaattgagcatgcgcaattaaaacgcgccgatctttttcgagtacatggagaacagtttaaaattgtgcttcgcgaatgggatcctcttttgcatgaaaacatgaaagcaaccagcttacaatccttcgaggtgattaacatgtttgattattttcaggaagcaaccgaggtatttgatcagacgataacagttaatgatctggattttggtgtggctaacacgcatagagttgaagagattaaaaaaaatcgttatcttatttacgatataaatcaacagcttattgctcgtgttaattatcggactgatcaaaagcaagtagcctctactgagttatttgatggttttggtaatttatattgtgttaatatgtatgattctcgaggctttgtttctctatctcaatggtacacacctgataataaaattggttccgaaacatggcaaagtcccgaagggagaacggttttagaagcatttaacaaaattaatagtgatggatctgttgaaaaagtttgttggcggttgatgagtagggtaggcgaaatccatatttttgatacacttgagcaagtaaccttgcactttttaaatttgcttaatgatgagtactggtcaaaaaatgaaccaaatatttttatattagatcgtgcacatttagctcaaactgtattgcgttatttggataaaccatcgtacaatgtactttttttgcataattctcatgctagtgacgcgagtcatcctgaaaagggcatattaaataataattatgagtatagtttgtttaatattaacgtctatgatgctttggttagcgctacggaaaggcaaaccaatgatattcgcagtcgattcaaaccaaccacgaaactatttacaattccagttggcgttataccaatgaaacagttacaacagcaacgtgtgcctatggcagagcgaacatttggtaaagtcgtggcattggcacgtaaagcaccagaaaaacaacttgaccaattagtaaaagcggttgcgtatgcgcgccagcaagtgccacaaataacgcttgatttatatgggtacaaggatccaaccaataattttcttgctgaacgtttgattgagtcagccattagagaaaataatttagaaaacattgtgacattgcatgattatactgatcaggttgcattggtcgaacaagacgcgcaagtttttggtgttacttcaagtatggaagggtttaatttatcgctgatggaagcgttggcacagggagacattggggtaacttacgatgtcaactatggtccaaatgcaattattaatgagggaaaaaatggttacatcgtgcctctaaatgattacaaatctatgggtgaagcgttaattcacatcttcaaagagccacgtctcatgcaacaactcagcgacacatcctatgaaatgtcttatcgatatagttctgacacggtgtgggcacaatggtgtttacttttggtcgatgcaaaaaaaatgtggccagtcaaacaagctaattattttcatatgacgattaatgatctaaagggtgcggatgaggagagtgaatcatgaattatttcatttcggagaatgcatttgaatttaactccggtactgaattttctcaggctgctcgcacatcgatgtataattcatttggcaatttaacgttatttgttacacggaattatacaccagtattccatcggacaattaaaacccttgggttaaatgatcatcaagttttgaatatgtatgattttttccaagaggcgacgcgggttagccgagtcaaacaaaatttacgcgaatctgtcacaattcctaaaaaaagatacgtcattgaaagtcctaatcccgaccaatcattgatcctaaatgaggggcgcactgttgctaaggtaaatgtcatgccggcgacagttgcgctaatgggtaatattgaatactttgatcgctttgatcatattgttgcacgtgacgaatgggactatcgtggttttaagtcgtcaaccgcttattttcatccaaatggtgaagttagtctgcaaaaattctatactcctgttgggaaagttgttttagagatcacacatatgaatgtccaagggcatttgatgccaacgatgtataagttgattaattattgtggtgcaaattaccggtttaatacagaaaatgaattatttaccttttttatgaacgagcaactgaaacaaaatcctgggactataattttagaaagagctagtatgttgaataccataccgggaataaaaagtacaaaaggaaaatatttttatttgcatagttcacatacaaatttgaagggacaattgttgacaacattagttgaattgatgcgcggggaactagattttaccggtattattgtggccacgaaacaacaacagcaagatatgcagccattaacaacactacccgtgttggctgcaccagatacgattgtcaaagaaaataaaacaaattcattggccaattgtaaatcacataaaattttagtattgggccgaattgctaaagaaaaacaaccacaagatgcgctgtatatcctaaaaagcgtgcaagctagtgtagcagatgcgacgctagaatttcggggttacagtactgatcggcagctattaaatgagttagatttattaattgaacaactagggttaaaaaatactgttacatttggtaactatgttgttggtaaaatgttggatgatgtaatagaaggagcgcaagtattgctatcaaccgtaccaactgaagggaacggtatgcaaaatattgaagcgatgtcgcatggacttcctgtaatcgcgtataatgttaattatggaccaaatacatacatgtcaaatgaacaacttgtaccaattggtaattatgatcaggctgcaaacagaatagtttcgctatttcaagatgataagcaatggcaagaggctagcatattagcgtcccaacaagcacaattatttaccaaagatagcgtttataagcagtggcaagatttgaacttgcaatgagttaaatatgatttagtctaaaatcaggagaattgatctccgtacatatgaggtactttcgatgagaattcacattatgccaaactggagcgaacttggcgtagagataccacaatttaatgacagcatccatcaagcacaattatttttagaacaaggacaagaagttgccttcatcttgtgtgattatctacccaaattgcgtggtatattgtcaaacaaaaatattgataaagctaccgtttggtcagcgtttgatgtattacaacatattgacttgtcagcgccacgacctgtggcattaaatgactttacttggccggattatgcagagtttatgacgttgaccgatcgaattctagtcaacgtttctggccagcactacgcgacaatttggagtaatcaattatcatttgaccatattgacttgtttgctgacgatatgatgacgcaacaattaatcattgatgatcgaggatttgtatcaaaagttatcgtatttgatgaggggaataaagttcgaacagactacttgacccctagtggtgatattgcgttgcaagaggatgaactgactggtcttgtaacaacgcaacagttgtggacagagcagacacaattttctaatatgacggtattaattcatgaactcgtaagttattacttgaataaaatacccgatgatgaaaatataattatttctccaagcgtaactactggtgaaatacttgaggatattgctatcaaacaaccaataattgtcagcgtacaaaataattttgttgaagtaggcaaggaattgggaaaaattagcgattttattgttacggacaatgagcgacatcaacaacaagtaatagcatttgatggtgaaacaaaggaagttgctatcgttccaccatacgcaacagatatggtggaaaacgaacatctccagactccactggtaagtctatttatttcagcacataatttatctgttgcacaacaaacgatagttattgctgcattaattaatattattaatgaatatgacacgacgacagttgtatttgaaacttctgataaaacttcagcaatgcaaaaacaaattcatgaagcgagtttaaaagctaaaaatgagcatggcttggtagatcaggacagtcaaatggcctttaaatcacgttttcatttcttggagactcaaaatgaagaacaacttgtgcgttatatgaaacacacgcaaatcctaattgatttggataatgaaccaaatcaattcttacaaaccgtggcaattaatttttctataccacaaattaacagcacggaaacagtctaccttgagcctgataaaaatggtaaagtattggcagactttgcagagttagacaaagcaataagtttctttttggataataaaaagcattttgaaatagcacaagaagtatccgcagacatacaagcggaatatactagtgaaatgctatggattaaatggcagcaagtattcaacaaaatcaaaagtaagatgaataactaaataatttgatgcaatgacaggtgaaaaatgacaatatcaattttacaaattggcgcagaaaactgggcaccatatattactgataagctcgattggcaccatacatcagtactggacctacctacttttttagccatgcaaagggatccgtacgtattagaacaaacctatgtgttgctcacagatgatcatcttgaaagcacgctgctatctagtcaaattaatgaatggcctgcattacgagtgatttactttgctcatgaagtagcgtctgattttcaaaaaattcttgatgagcgacgcgcttttcatattgaagaaaatacaccagaaaatgttgaaaaaagaatagttactgatatggataccagccaatatggtttttcgacacgctttagcgccgaacaatttattccttatgtgcctgaaggaattcatttgcaacgacaaggagatttttcaacgcaatttgaaggtgaatttggagaagattggcaacaattaggaacactaaaggctggtacaagtgattttcaaagtggtcgggcaaacgaggtatggttggaatacaatcatacagagaaagccgaaccggccttgctatttgtgttctataaaaatggtgaagtattgactcaacagttgatagctggtcaatcattgcgccaattgacaactgtagcgccccctgaagattacgaaaattatgaaatcttggttttgggtaaaggtcagggaacccttgatttttacgtcattcaccaaagagtctctcgacatgggttgggtcatttgctaccaggtggaacgtggcagcttaccaaagaaaatgaagaagtgttaagttactttaatcccggagatcgtcaaaaaccactgattgtcagttttgcggatacgaggcttcatgttgatgggtttgaaatgcaagaagcgttaaatcgtctaggaacaccatatttattgtttacagatgcgcgtatacagggtggcgcatttgatattggaacagcagaatatgaagcgaccatcattagaataattaagcaaaaaatgaaaacattaggactacgtgccgaagatcttattttgatgggtgcttctatgggtagttaccctgctttgtactacgctgctgatcttaaccccgctgctgttgtcattgcaaaaccaattattaatttgggcacattcactgctggatcaactatttcacgtggctttgattatggttggcgtttagatgtacgacgttatttgagtggctatgttaggcctgatgataacgtagccatgaatgaaaagttatggaaacacattgagaatacgaactggacaaatatcaaagtggcattattttcgatgtctcaagatgaatatgatggtcagagcttaggtcaattattagatttctttgccaagcataatgtcccagtaaagcatgaaagtgaagaagggcaacatacggagaaacttgatgaaatggttgacttcatgatgactaatttaaatgtattacaaaacactatgcgagcggagggtgaataatgcaatatcaaatttattggacacccaatactgaactgctgggacttcaaggggcaacagttgacttcaggtcgttgaatgaagtgtattatgaaaattattttttaccaagtggagaggttgttgcgagatggcattctacatacaacagaatgagtggtcaaccggtggtgaaggcagacttgccccagctgtcacacggtgagacatatgtgatagaacgtcatattgatgccagtgaccggatgtttgcctatttggtggtgactttttttgatcagcaataccagccaattgctactttcagtgaaaatactgaaagactgttgatcaatacaccagatgaatatgctttctatgttattgatttagtttctgcaggaagcggacattttacatttcataatttcgatattcgcataaaaagggctggtattttgcgagaagacgaccaagaaatagcgccacaattatataattatttgcaccagccagagaaagtgacgagtaaagtattacgggttattttttcagagccagaagaagcggtaactgactatgtcacgaaaaaaataaaaacaacgcaacaagccgtattatttgttgcaagtggcacactaaaagcaggttattatcgtcagttagaactaatatcagccattaaaactgcacgaaaacaggctaaggcgcacagtcttgagtttgttggttatggaccaatatctagttacgctgccctctattatcatcaacaaattaaaaagagtgtggccataattagcgaagatattttattgtcccctggaaagtcagaatggacaattgaacgtagcgttgatggcgtcagctatcttactagttcgataatgcccaacactcaacttgatctaatcatttcacatccaaaatatgagcgattagaaacactgacatatgagacgccaacgcctgaagaatatgagcagcaattgttgtatgaggcagcacatccaaaacctggcgcattctctaagctttttggtcaaaaaaacaaatgataagttatttataaccaacaaaaaagagccaaacatttacttgtttagctctttttctgttggttttttaaggtaacagtagctatactcgttaattggttagtaatattttctgtaattttaacatgccatacttgaagtgaatgaccaatattaactggggttgcagtggcaatcaaaattcctttgcttactggttttaaatggtgtgtttggatatcgacaccaacaggaaattgattatcagataaagcttcttttgcacctaatgaggctgctgtttcagctaataaggcgttaataccaccatgaacaatgccataaggttgcataattttatcagtgacagctaactcaacaactgttttatcagcagacaatatggtggtttttaattctaaaagttctataatattcataataactaatttcctttctgaatggagtataacaaatgacaacttggagcgctattaagaagtacgacgagattctttttgaaaaaaatagtgatggcaaaaatcctggaaaaattgctaaaattacgatgaacgacgtcgcaacacacaatgcttttacaccggggatggtatctgaaatgatagatgcttttacaattgcacgagataacgctcaaattggtgtgattattttaactggtgctggagataaagctttctcctcaggtgggaaccaaaaagtacgtggtaatggtgggtatgttggttctgatggcattcctcgtttaaatgttttggacttgcaacgactaatgcgtattattcctaagccgattattgctatggtcaagggttggtctgttggcggtggaaacgtattgcaattggttgctgatctgactgttgctgctgacaatgctaaatttggtcaaacaggaccaatggtaggctcgtttgatgctggatatggttcaggctatttagctcgagtaatagggcataagcgtgccaaagaggtatggttcttgaatcatttctatactgctgaggaagcctaccaaatgaattggattaataaagtggtgccaataaatgaagtagaagacgccacaattgaatgggccgatgaaatgttgactaaatcaccaacggcgctacgatttatcaaggccgcaatgaacgctgatacagatggcttggcaggcctacagcaatttgctggggatgcaaccatgctgtactacacatcagacgaggctaaagaaggtcgtgattcctttaaagaaaagcgcgatcctgattttgatcaattcccaaagttcccataaataacggaggcttaacacgtatgaccttaaaaattgcgattgcacaaattgatatagcactggggaaaccagccattaatgagcaaacagtaatcgagtatgctcagaaagctgcatcagtcgaggctgatattttagtttatcctgaaatgtggaatacggggtatgatctccttaatttggagaccgtagcggatcctcaaggacaaagaagcgttaatttgttgcgtgatctcgctaaaaaatatcatctcaacattgttggtggttctgtggcaacagcccaagcagagaacaaattttacaacacgatgtttgttttcaatgacaaaggcgaacaagttagtgaatacaataagttacatttatttggactaatgaatgaagagaaattcatgtcagcgggcaataaaacaaatctttttaatttggcggatgtaccatctgccggtgccatttgctatgatattcgctttccagagtggttacgtactatgatgagtcaagggccacaagaaattttgtatatcgttgccgaatggccaattcaacgaataaaacaatggcaacttttgctgcaagcacgagctattgaaaatcaaacatttgtggtcgctgcgaatcgtgtaggtcgagataacaacaatacatttggtggtcgttcattaattattgacccactaggaaatattgtccaacaagcaagcgatgacaaagtggaattattagtagcagaaattaatattaatgatgaaaaaactattcgaggagaaatcccagtgtttagcgatcgtcgtccagaactttacagataaggtgaataacgtatgcattttgaagaatccgacttacttaaaacactacctaaacaattttttgcaacacttgttgccaaagtgaatgcgaaaattgctgccggcaaagatgtgattaacttggggcaagggaaccctgatcaacctacccctgagtatattgttaaatctttacaagcggctgcagaaaatccggctgatcacaaatattcattatttcgcggtgaagaacgttttaagaaagccattgcagaattttatgctgatgagtatggcgtgtcaatcgacccagaaacagaagtagctatattagccggctcgaaaattggtttggttgagctgccgtgggcattaatgaatcctggggaaacattattattaccagatcctgggtaccctgattatttatctgccgcagcattggggcgcgtaaattatgaagcagtacctttaaagcaagaaaataattttttggttgattatgaagcgattccaaactcagtagctgaagcagctaagtttttatatttaaactatcctaacaatccaactggcgcaattgcaacttcagaattttaccaacaaactgttcgttttgcagaagaaaatcaggttggtattgtatctgattttgcctatggggcaatcggctatgatggccataagccactatcatttctacaaacagaaaattcaaaaagtgttggaattgaaacgtatactttctcaaaaacgttcaatatggcggggtggcgagtaggatttgctgttggaaatgcagagatgattgaagcgcttaatctaattcaagatcatttattcgtttcattattcccagcggttcaagatgcagcaattgaggccttaacaaatagagcagcgcgtgaaaaagctgttacagatctgaccaatctatatcaacgtcgtcgtgatgtatttattaatgcagttcgagaatttggttgggaaccttacgttccgcagggagccttttatgtgttgatgcctgtacctaaaggctatacgtcgagtgagtttgcagatttactattagaagaggctgatgttgctgtagctgatgcatctggatttggtaagggtggacaaggttatatacgtgtcggattaacaattggtgaagaacgtttagctgaagctgcaaaacgaattagtaagttacctatattttcaaagtaagctggagacagcttatttttttattttcataaaaaacgaacgttattgacttgttactggaaataaacaatacagatacgattaatagtttgcgaaataagaaaaaggacaagtaacttaaaccaaaattagcattggcataatcattggtttgcgagctgtttctttgaataggaaacgagacaagtcatcaataacagcttgacgaatatctgactcgctattgtttgaactattcataacgcggcgcattgtgctgaaaatgacacgtcgaccttcattaatcaaatcgccagattcacgcatatagacaaaaccacgtgataaaatatctggtccagataaaatttctttctttttcaaatcgattgttgcagtaacaacaactaagccatcttgtgacagcttttgacgatcatgtaacacaactgaaccgatatcaccgattcctgatccgtcaatgtatgtgtcatcgccagggaaatgtccagcaacgcgtgcattttcaccatccagagccaagacatcaccattttctaaaatgaaagtatggtcttctggtacttctagctcatgtgctaatgaagcgtggacttttaacatacgatattcaccgtgaacaggcatgaaaaatttaggcttcaacaaagcaatcattaacttttcttcttcttgaccaccgtgaccagaagtgtggatgttattaactttaccatagatgacattagcgccaccttcttgtaatttattaataacagcgtttacagatgctgtattacctggaattggtgaagaggagaaaataacattgtcttttggcttcaaacgaatttgcttatgtgttccttcagcaattcgtgccagggcagccatcggttcaccttgagaaccagttgatagaataagtaattcatcgtcaggaatatgtttgatttctgattgttcgaccagcatatcatcagggatatttagatatcccaaggcacgaccattagtaacagctgattccattgaacggccaaataccgcaattttacgcccatgtgcaatagctgcatctgtagccatgcgaacacggttcatattagaagcaaacgttgcaaatataatacgtccatgttgaattttatcaaatatatggttaacagattttgctacccatgcttctgacttcgtccattcagggcgttcagcattggttgaatcactcatcatgagtaatacaccattttcgccaatacgtgccattgaccaaaggttaggtggctgcttagtagttggtgtcagatcaaacttaaaatcaccagtttctacaatagtcccaactggtgtgtgtacagctacaccaaatacgtcaggtatagagtgagtggtacggaaaaactcgacacttaactgatcaaattccagtactgagccatcagtaatttcatgaagttcgacgcgattaagcatctgtttttcttcgagtttgttcttaattaatgccattgctaatgggccagcgtaaactggaacattaacagcttgcaaaaagtaggcgattgcaccgatatggtcttcgtgtccgtgggtgataaccagtgctttaacgcgatcgatattatcaactaaataagtatagtcaggaataacgtaatcaataccgagcaattcgtcttctgggaacttaatgcccgcgtcgacgacgataatttcattttgatactcgataccatacgtgttcttaccaatctcgcctaaaccgcctagcgcataaactgcgacttcgttaggtttgatatctacagaatatgtcattagaatgttgtaacttcgaagttgggattggctttttcataagtcacagccttatcagataattcttcgataaactccacattgtattctgtgttttcctcaacaatctcacgtgcttgtggcaaactttcggcctcaatgtacattgaaattgttgtttcacgctttggattgcgctcagggtgttcttggtagtaaattttataaatcataaatgcctccattaatatagtatagtaatttgtcacgaacaaaaccttattttctagtttaccacataaactaagatttcaaccacttgcttgattaataaagcaataattgataaattattattagggataaacatatgaaaatatcatctattggcgtttttatgggatcacaatcaggtaatgacccacagtacatacaggcagcagaagaacttggtaaaagaattgctctgaaaaaaatcaagttggtttttggcgcagggaaggatggcttaatgggtgccaccgcccgaagtgccatggaatccggtggttcagttctagggatttcacctcgtaatcttgctgaggaggcatttgaggcttcagaaattacgcagttaatagaagtgaacacgatgacagatcgtaagcaactattaatggataattctgatgtttttattgtgctaccaggtggttttggaaccttagaggagatagcacaagttatcagttggtcaaaaattcatttacacgataaaccgttggcactttttaatgttaacggtttctatgataaattttgggcatggttaaatgaagtttacgaagatggttttgtaagtgagcatgatatgagatgtattcaaatgtttgattcaattgatgcaatgttcgagtatttagaaaattttgaaggttgatatatgcaaaactcagaattattgaatgaatctattaatgtatatatgtcggcattaaagaatcttgaaaaactaatttcgcaaccaacgagcgaatatggtgcttcttttgagcagtggcttattatggccgctgttgcggatagtgatgagccactaacgatgaccaaaatagctaaagatcgtggtgtaaccaaaggagctgttgctcgccaattaaaaccattatttgattgtggctacttaaaacatatgcctgatgaaaaagaccatcgccgtgtgctactagttttgacgtcagaagggaaggatgttgaaaaacagatgacgatgaaagtgcaacagcgttttcataaatggttggatatttttggtgtagaagaaggcaaatcctttcttaaaacactgaaacgcttccaaaacttaattgtccaaccggagttaaacaaaaaaaacattgaacctaatcaggatttgtgatagaatattaacttgtttgaagtctgcataaattacggatttctgttataataaactatattatcggataaagaggatactaatcatggcaatcggcatgaatgacttaaagacaggtttgactattgaatactcaaactcaatttggcgtgttttggatttccaacacgttaagcctggtaaaggtggtgcgtttgttcgttcaaaattgaagaatttacgaactggtgcggttaatgaagttactttccgtcctggagataagtttgaacaagctgatatcacaacacgaccaatgtcttacctatatgctgaaaatgatggccgtgtatttatggatgttgaaagttatgatcaaatcaacattcctgatgaatatttaaaaaatgctttgaagtttttgcttgaaggtatggaagttaaaattaccatgtttggtaatgaagtgcttggtgcagaactaccatcaactgttcaaatgaaggtgacagaaacgcaaccaggtatcaaaggtgcaacagcaactggttcaggaaagccagcaacggttgaaactggtgctactattactgtacctgactttgttaatgagggtgaaaccattattattaacactgaagatggttcgtacaaaggtcgcgcctaattaaggtaaatgcacgattgttgcctagttacaagtaacatttgagcggtagtgaacgtgtttatcataaaaagttcccccgcggaactttttattttagaaactattttcgaggagcaaatatggccaaagaaattaaatacaataaagcaactactaagaatttgttattaatcactgagagtgaagtacctggaaccacgcaggtaacgccagaagtgattgaagtcattgcacaaatcgcggcacaagaagtgtctggtgtttactcaatgagaggtaaattatcagaccgatttgccagtgtgtttggatcaactgcccgcggaaagggcgttgaattgcagcaaacaattgatggcttagtgattgaagcgtatgttttcttgcaatatggtgttccagtaccaaaaatagctttaaacattcaaaatgcaattaagtctcaagtttcgtcaatgacagatttagaggtagcgcgtgttaatgtgcacgttagcggaattataccggaaaagccggatcatacgattgatcctgataatttatttggtgagaatgaggtagctaattaatggcaaacttaacgcgacatgagtcacgacaagctgcatttcaagttctttttgcattagaaaaagatccacagagtaataaaattgatgatttatacgaaattgtgctaaatggcaaacaatttgatgactatttgccacgattagttaatggtgttttaggttccaaggcagatttggatgaaaaaatttcatcacatttagctgaaggttgggcgattaaccgtatcaacaaagctgatttagttattttacggttagcaatttacgaattaactgctgtcgaagcaaccccatacaaagttgccatcgatgaagctattgaattagcaaaaacttttgctgatgaagatgatcgtaagtttgttaacggtgttttaaaacattttgcacgtgatgaaaaaaccgcttaagtagcggttttttcattttaaacgtgtgtattattagtaatgtacttatcatgatatactaaacaaagaataatttattactggagactaaaatggcgatatatgatccaacgaaaacaccaacagatagttatgatacccatacgcatttgaacgatgaccaattatttcatgacgtgccagcgtatattggacgagctaatgagtttcgtgtaatggaaatgaatgtggtgggatacaatgcacaaagtaatgaacgtgcattagaaatttcaaataaccatgataatatttatgcagttcttggttttcaacctgaggatacaaaggattttgatgatcaggcgtttatcacattggaacagcaactacaacagccaaaggttgttggggtcggtgagacggggttggattattattgggaaacaacagctcacgatgtccaaattgcagcatttaaaaagcatcttgagttagctaaaaaatttgatttacccgtcattattcataatcgtgatgcttttgaagatgtttataaaatactaaaagattcaggtgttaaaaagggtgtgatgcacagtttttctggcacaccagagcaggctaaggcatttattgatctaggaatgcacatttcttttagtggtgttgtaagttttaagaaagccgaagaagttcgtgaggcagcaaaaacaattcctctagatcgtctcttggttgagacggacgctccttatttggcacctacaccttatcgtggtaaaacgaatgagccggcgttagttaagtttgtcatcgatagcctggctgaaacattagagatgtcagctaaagacttatcagatgtgacacgcggcaatgcacatcgtttatttttaaatcatgaatgagttgcctaaaattaacgaaatgattgttgttgaaggacgatcagatacgcaaaatcttgcgcgtgcagttattgcggatactattgaaactggtggtagtgcggttaatgaagatgcgattgagcgagctaaattagcagctaaaacgcgaggaataattattttaactgacccagactttaatggtcagcgtattcgtcatatggttacagaagcagtacccacagctaaacaagcctacttgacgcaggcagaagcacgtgcaacaaaagataatccgcataaatcattgggggttgaacacgcaacgccagatacgttgcgaaatgcattggccaacgttattacaccagtgcacgcaattggaataacttcagatattgatcgttcatttcttctagatttaggactactaagtgggccagaagcgcgtgttaagcgggcatttgttggtgaacagttgcatattggttatgcaaacggaaaacaattgttgaaacgattgcaagcatttggtattcgacgtgcgcaagtggaagatgtacttaaaggaaaatattaaaatggcacagacaattgacatagccaatccaacgagaacacaggctattttaaatgaatatggcttacgagctaagaaaaaatttggtcaaaactttttgacagatttaaatgtactacataatattgtcgaagcagccgaaattactgcagaggattatgttattgaaatcggtccaggaattggtgctttaactgagcagttagctcgctcagctaaaaaggtgttagcttttgaaattgattcgcaaatggttgaagttttagctgacactttaaagccttatgataatgttaaagtaatcgaaaatgatgtgttaaaggttgatttggcaaaagtcattagcgaagagttcggtgacaacgctcatgtaaaaattgtcgccaatttaccatattatattaccacacctattctcattcagcttctccggtctaatatcaattgggataatatcgtagttatgatgcaacgcgaggtagctgaccgattaaatgcggcagtcggaacgaaaagttatggcgtactaacgttaaccatccaatactttgcacaagcaacattagcaatcaaagtaccagcgagttcctttaacccatcacctaatgttgatagtgcagtggttaaattaaccccactaaaaccaaccactgtcgtcgataatgttggcaaactatttggtgtaatcaaaggaagtttttcacaccgtcgcaaaagtttatggaataatatgttacaaacatatggtaaagatgcaggaacaaaagaacaattaacagttgctttgaaatcagcgcaaattgatccagcaatccgtgctgaacgactgaatttggaacaatttacgcaattatatttggcattacgtgatcaaaatttaacacaataaacgaataattattcgacaatatgttttaatattcgcagaaaattgcaaacattccttatttatggtataattaaactagcttttacacgaaaggtggtataaaaatgccaagtagtttgcaagatattaaaacaaagattgacgctcatgtgggtcaagaagtgacgattattgcccaagctggacgaaagaagatcacggagcgctcaggaattcttcgttcaacgtttccttcattgttcgttgtcgaattagatgaggatgctaattttgaacatgcttcatatagttatacagatattttaacaaagaatattgacattacattcgctgatgagttgcccgcttaagggctttttttatagcgattacagataccactttagaaacgaatgacatgaataaacaatccgtttatgcaattttaacgattatgttaatccctattgggattcttttagtgtgtgctaaaatggttggcgacacaactgaagcacaggatactgctgtgaaaattacgacagataatccagcctatcaacaaattgcaaaagctattgccggcaaaaaagggcgtgtcagcctcatgtcgggcaatctcaaaacagcacaacagaaaacaaaatttaaaaagtctgaactacttttgacagatgatcacacgagtgcgctgttaacagaagctcaaaagttacatagtagccctaagttagtaattgcgagtgactatattcatacagactcgtcaacacagaagtattatttaagcccaaatacaacagtagtaatggcacaacaaatcgtgaattatttgagtgacatggatccaagaaatcgtgatacttatgtcgaaaacaataagcaatttgtggaaaaaacaagcgacttgacgacgctttacacaaccctaaaaaaaataaaagatattcggtatgtcgctacgaacaactcacagcatttgcttatgacacaattgggatacgctgctgaaacagatgatgtatctaaattaacggataagcaaatgtcagatcttgagagtaaattagctgataaaaaaattcagtttatttttacaacgtcacaggacacaactgaaaataaacaaaaacttgtgactatggcaaaaaaagatgacatccctgtcgtcacgtttagtcaatttacgcctgacagcacgaaaatttggacttggcaattaacgcaactcaaaaaaattcaaaaggcattagataaatgaatacaatcattagcacgaaagatttcatggttcggtatggggaaaaagttattttatcgcatatcaacattggagtattagctggacagtttctggctgttttaggagaaaatggtgccggtaaaacaagtttcattaaagcactcactggacaaaataaacaaacagaaggtacattaacggtagcgacgaatcgtattggatatgtcccacaattcagagatatttctcgtgattatcctttaagtatagctgaatttgtcggactgaatttcaatcatggtagccgcttatggcttactaaagaggaaaaacagttaataactcaagctttaaagcgtatggacttaaatcaaatgcgtgatcaacgattgggactagcatcggggggacaaaaacagcgcgcatttgtagctcaagccttagtaaaaaatccagatttgttaattctagatgagtctactgctagtttggatcatgaacacaaagtgcaattattggaaaatgtccgtaccttacagcaaaccacaaatatgacagtgctatttattacacatgaaatcaagctggtcactgattttgcggatggctatctctcttttgaaaatggtaaagtacaacaaggggatgctacccagctgcaaacactgacgatggatatgacgtctaggcacaaagaagatgaggtgcgccatgtttagttatgattttatgcaaaatgctttcatagcaggtacgattgtcagcattgttgccggggttatcggtacatttgttgtggcgcgaaattatgcgtttttaacgcactctttgagtgaaataggttttgccggtgcagcttttggtttgtggattggttggccggctttattaggtatgatgattgcaacttctgttgcttcagtagctattggcgccttggaatcaacgtatacgaaacatgataatgtcacaagtgctgtatctgcgttggctattggtttgggaatattatttttagcactaggtcatacatcatccaatgctgctactggcattctatttggttcagttcttggaattagccaccgtgacttatacttgctcataattttagccttaattgtattagttacgctactattcaattaccgctccttgcgtcaattagcatttgacgaagcaggtatttttcttcaaacatggaaacaaaaatcagttcgctatacctttttaatcatgattgcattatcgattagtatttcatcacaattggtaggatccttacttatttttgtgttggtaacattacccgcggcgagcgcaaaatattatgctaaaacgacgttgcagcttatggggatggccattgtcttcgctttgttcggtacgtggattggcttgacaatcgcttatttaacaaatttaccaacaagtttttttatagctattatagaagtaataatttatcttgtttcaatatggcaattcaaacgaaatgcctagtttccgaacaattagaaaataaaaatggtataattagtcgtaaatattaataaaagtttaggaggaaacggactaaaataacttttttggtccgtcacacatcatgaaaacacgtcgttctgaccggttagtcgatatggcgcgctatatgcttgagcgcccacgcaagttgatatctttatcttatttttccaaaaggtatgaatcggctaagtcatcaatttctgaggatctatcaatactcaagcgtacattccaagaacgtggtacaggtttattggagacggtacctggtgctgctggtggggcacgttttattccttatatgactgagtccgaagcagcagaatttattgacgatatttgccggttagtaaatgatgagacgcgcgtattgcctgggggttatgtctatctatctgatttgttaggtcgtcctgatattttacgacaagctgggcgtttaattgcaacacaatacatacgtgatgatattgatgctgtcatgactgcagcgactaaaggtgttccgttggcacaagctgttgctgatcagttaaatgtaccatttgtaattgttcgcgatgatgcgaaagttaccgaaggtccgactgtatctgttaattatttgactggatcatcaaagcgtgtcgaaaaaatggaattgtctcgtcgttcactgcgcacaggttcacgtgtgttggtcgtagatgactttatgaaagctggcggaacaattcaagggatgcaaaccttggttggtgaatttgatggtacggtggttggcactgcagtatttgctgaaggccgttcaacaaccagattacttgatcacttcacatcattgttgcatgtcgacacaaacttgaaaaatggtgatccaattttggttacgccgggtaattacttgaacgaaatatttaaacatgaggcttaattaaacatgagcaatataaacgtattaatattggcagcaggaaatggctcaagaatgaagtcaacaactccaaaagtattgcatactgtggctgggcaaacgatgattgactgggtactagatgctgtcgaaccacttaagacggataagttaatcactgttattggagttggtgctgaacgtgtccaagaacatgtcggtaatcgtagttcatttgtactgcaatctcaacaacttggtactggtcatgctgtgcgtcaagctgaggcagaacttaaagacagcgatggtgtcaccctaattatgtctggtgacacgccaatgtttcgttcagaaaccttacaaggtttcattgcagagcatgaacgttcaaataacgctgtgactgtactaactgccattgccaatgatcctactgggtacggccgcattgtccgcggagaagatgagacagttcagaaaattattgaacaaaaagatgctagtattacagaacgtcgtattaaagaaattaatactggcgtatatgtattcaataaccgtttattatttgaatcactagcaaaagtacaaaataataatgcgcaaggcgaatactatttacctgacacgcttaacattttgcgacgctcaggagaacagattggtgcgcacacactccaagactttacagagtcattaggagttaatgatcgagtagcattggcaacagctaaccgcgtcatgcacgaaagaattaatcatcaattaatggttgatggcgttgaactgttagatccagcgaatacatatattgattcaacggttaacattgggcccgataccttaattgagggtggcgtaactattttaggcaagacgaccatcggcgtaaataatactattacacaaggatcacgaatcgtaaatagtgtgcttggtgacaataatgtgattacatcatcgcacattgaagatgctatcctgcaaaatggtaccacagtgggtccatatgcacatttgcgaccggctgctcatttagaagataatgttcatattggtaatttcgtcgaagtcaagaatgctaaattgggtaaagacaccaaatcaggacatctcacttacataggtaatgccactattggtcaagatgttaatattggagcaggtacgatatttgttaattacgatggggtgaataagtttaattcaactgtcggagatcgcgcgtttattggctcaaataccaaaatcgttgcaccggttaacattgctcaagaatcaattactgctgctgggtcaacaattacaaatgacataccagaacatgcaatggggattgctcgtacacgtcagacaaataaagaagatttctggcatcacatgccacataaattttaaataaaaaagagttcatttgagctctttttattttggtatttgttgttaattatgtttataatagaaagaaactttgagaaaaattattattacgaaaataaaaggggatttttgatgcaaattacaggtgaacgtgcattagtcaatatcgaaaatgaaacattctatacaaagagaatagacgtagctgatgacgaaacaattccgcttgatgcgcttttttcagaaattgattcacatattgaaaatgaaaactttatacatattgagttgcagattaatggcggagtagagtccacggggacgacattaagtgttgaaaccaatgtcattaatttacccttgcgctatcaaaaccaattacgaaaactggtttggcaagaaaaagacgcattagatgtcaatctgtatatgattgctgaaaatgaatttgagagtcaatcccatttgaaaatatcattagcaagctctgttgccacatacgtagatgattctgagagtgtgaaggctaaaatttccacatggtttaatgaacaacttgaacatattgttaatgaacaaaaacaagcggaaaaggaagatgtgggtgtcgaagaataagcaactgccctcagtctgcctcaatataaccagttacatgtaagagtttattatcgtctagacaggtaaagtctaatatgtgttttgaaaccgtggttttgacattatttagttcccctaagttgtaggtgtcgatagtatattgagctagtttagccttatcatttaaatcagacataggcacaattaaatcctctaaggctgttttagtggggttagcaatgcggtcaatgtagtttttttcaagctttgttaattttatcatggttataattataacgattttgctcgtgtgtgtaaacgaaactacttgtttggttatactgaaataaatagaatattttttgactattttataatttattgatataattgatgtatgcgatgagtcgaagcgcttgaaaaattagcgctgattgcggcctactgtgtttaatcacaagtctcgtatagatgtaggtgatgagtgttgttgtggaactcgctcatctcacttgactaacagtgcttgcactgtagtgacgcgactttgctattgatgtgacaatcaatagccgccagccagagcgaatctggcacgccaaactaacaactaacttaggttagttgtttttttatgcagattttaatgtataattgtagtagaatttacatgttattgaattaagtaggcttaaaggaaaaatggaaaaagaacgaaatcaatatttaacggtcagtgcattaactgcttatttaaaaagaaaatttgatgctgatccgtatttagccaaagtctatgttaccggtgaaatttctaatatgggtcgtcgtcgcgggccacatttatatttttctattaaggatagtgaaagcaatgccgtgattaatgcatcaatgtttggctatgaacggcgtattaaatttcagcccgaagaggggatgaagattaatgcgattgggcgggtggaaatatatgaaccacggggctcatattccattattttggaatcaatgactcccgacggcgttggtgaactatttttagcttatgaacaactaaaacgtaaactacaggccgaaggattgtttgatttgccaaaaaaacaagtaccactatttcctaaaaaaatagcggtagttacttcaccaactggggcagttattgaagatattgctcgtacggtgcaacgacgttttccaagtgctcaggttattttatttccagcagtagtgcagggcgaaaaggcagcgccaacaattattcggcagctccaacgtattgataatatggattttgacacgttaattgttggacgtggcggtggttccattgaagatttgtgggcttttaatgatgaaaaattggcgcgaactgttgctagtatgaagacaccggtgattagttcagttggacatgagacagataataccttagtagattttgtttctgatcgacgtgcagctacgccaacggctgcagctgaactagcgacaccggtaacattacaacaattgaccacccgtttgcaagaattacatttacggcaaatatcacggattaaacagatgattgacatgaggcaacaacgattaaatcgagttgcaacgcatgttatttttcagcaaccggatcggttatacacggggtataatcaacgaatagatcagttatcgcatgcattgcaacagctaacaaaacaaaaagtaattaatgaagaacacaaattagcggcaatattgcaacgacagcagcagttacaacgtagtttattgcaacctgtacaagaaagattacaattattaagtactaaattagacttagtaagccctttgaaaatattatccagtggttatgcaattgttgagcatgacaataaagtagttcgtagcataacaaatattacgattaatgatgaaattgacatgcgcttttctgatgggcatgccacggcaaaaataacaggagtacagcatgagtgaacaacccacatttgaagataagttacaacaattagaaagtatcgtgagtcagctagaaaagggtgatcgtcccttggaaaccgctttggctgattttcaaaccggtgttggtttggtcaaagatttacaaaagacattgaaggatgctgaagatacattggcaaaggttatagataatgatgatgaattatcagatttggaattaactaatgattgatttaaaaagtttccaaaaagaatggcttccaaaaattaatcaacaattggaaaatgatttatcaatggcttccccagatgctgatttagttgctatgatgaagtatgcagttttgaatggtggcaaaaggctccgaccattgctgacgttagcagttgttacaagttttggagaatctatcacaccaagtatattgaaagtagcaacggcaattgaatgggttcattcatattcccttgttcatgatgatttgccggcaatggataatgatatgtttcgacgtggcaaacccagcgttcatgcattatatggtgaagccaatgctattttagtcggcgatgcgttattaactggtgcctttggagtcatagcgactgccaatagttcatgcagtgttgaggattgtcttccaactgaagagctattattaattactcaaaacttagctcgcgaagcaggtggatcaggaatggttttagggcaactccatgatatggataatcacactgaagaacaaaatgctagtacaaattggttgttaaatgatgtttatagcatgaagactgcagcattgataagatatacaacaacgttgggcgcaatattgacccatcaaaatgtcaatgttgaggataatcattttgatccgaagaaggcaatgtatgattttggtgaaaaattcggattggcctttcaaattcaagatgatttagatgattatcagcaagatcaattagaagatgtgaactcattgccacatatagtgggtgttaaagaggcacaaagtgtgcttgaccaatacctcttctcaacacaagaaatattagctaatactgttgaacaagatcaacaatttgatcgacgtttgctggatgattttgttagtttaattggagataaaaaatgagcattgaaaaagaacgtgttgatgtattgctggtccaacaaggattgtttcagtcacgtgagcaagcaaaacgtgctgtgatggctggtcagattcttggcaataacgaagaacgtttagataaagcgggtgaaaaaattcccgtgacaacggaactacatttcaaaggtgaacagctaaaatatgtttcccgtgggggattgaagttagaaaaagcattgaatgattttgatattaccgttgaaaataaaacggtgttagacattggttcttccacgggcggttttactgatgtttcacttcaaaatggtgccaaacttgtttatgcactagatgtgggtaccaatcaactagcttggaagttacgaaacgatgatcgtgtgaaagttatggaaaatacaaactttcgttattcaaaattagctgattttaaatacggacaaccagaatttgctacaattgatgtttcatttatttctttgggacttattttaccagcactagccaacattattactatgagtggtaatgttgtggccttaattaaaccacagtttgaagctggacgtgaaaatgttggtaagaacggtattatcaaagatacagctgttcataaacaagttttacaaaaagtaacacaaatgatggttactgatggttttagcattacggacttaacctactcgccaattaaagggggacaaggtaatattgagttcttagcagtactgaaacgatcaaatcaagccgaaatcagcgaacatattaatattgacaggttacttgaacgcacttatgagcaactcaatcataaggagaatgatcatgaataaaaaagatcgccaaaaagccttgttgtcgctcattaaagagcatccagtgggtcgtcaggaagatattgttgcgtattttgaaaagattggcgaaaaggttacccaagctacaatatcgcgtgatattaatgagttgggattaattaaagttccaaattcccacgatggctttttgtatcatttaccaaaatccgatgacaggccatatttacagcgattacgtcgagcgctacagcaatcatttttgagtttgcgtgcgcagcgtggaatgattatgatcaaagttcaacctggaaatggtcaattggtatcaaacctgattgagcaagtgcagctaccggaaatatttgcgaccataagcgatgatggttcggttctcgtattattaaaagatggtattcctacggcaaaagtgattaacattattcaaaagttacttgaaaaataacaacgtatagcatgtactacgttgatggagttacttatgttagaaaatctaattatagaaaattttgcgattattgaaaaagtggatcttcagtttgaagaaggcatgagtgttttaaccggtgaaacaggtgctgggaaatcaattattattgatgcactttttatgttaactggtggtcgtgcgaactctgaaatggttcgtcatggcagtaaaaaagctgttttacaggcagttttcagtgttccggataatcaaaagctaagagatctaattgctcgaagtggtgtagcaggcgatgataatgaacttattatttatcgtgaattaaaccaaaatgggcggagtattattcgaatcaatggtgttcttgtcaatttgaaaactttagcggctattggtcgttacttagttgatatccaaggacaaaatgatgcacagcaattactgaatccagaggaacatttaccgttattggatgcttttggtgatgaaaaaattacgcaatttcgaaatgattaccaagaactttttcaaaaatttcgttctatcaccactcgcattagaaatattcaaacgtcacaacaagaaatcacacaacgtttagatcttttaaaattccaacaagaagaactgcaggaagccaatttacagccaaatgaagaaaatgatttattagatgcacgtgacaagttacgtaatttcaaaaaaattgctgatcgacttcagttaacgcagacaacactaagcggcgagcaaggcggagccatagactccctcgctgaagcagttcatcaactacaagatattgcagaatatgatgatcaatatgctgagctagcaaaaacgatttccgaagcttactacacggcccaagatgttggccgtgatgttgacgaacaattgagtgaattaacatatgatgaggcagaactaattcgtattgatgaccggcttcagctgattcactcattagaacgcaagtatggtacatcggttgcagatgttttagattttcaagccaaaatcgaaaaagagctttcgcttatagatgatgatgaatatgatgttgaacgactacaggtcaaacaaaatgacatgcgccagttattaagaaaaaaagcgattaaattacgtgaggcccgacaaaaagtagcccgaaatttggaaaagaatgttaatcagcaattgaacgatttattaatgaatggggccgagtttgctgtacactttgatccagttgaaggctatatctcctcgggaattgataaagttgaatttcatgtccaaactaacgttggagaaggaatggcgcccttggtcaagatcgcatcaggtggagaagctgctcgcctgatgttagcactgaaaactacatttgctaagcagcagcacatcatttcaattgtttttgatgaagcggatacaggtgtttccggtcgtgtggctcaggcaatagcaaaaaaaatgctcacaatttcaactgattcacaagttttagcaattacgcatttaccacaagttgcagctgccgcaactcatcattatttgatctcaaagttaactgaaaatgatcgtacactcactcaagtagcaccattggatgaagatggtcgagttcacgcaattgctatgatgttatctggtgacaatattactgaaactgctcttgcaaatgctcgtgatttacgtcaagaattttaaattaacaaaataaaaaagacgcgcaatttaagcgacgtcttttttttgtgtttctaatgcgcaatgatcattaagaatgcaatgaacataatcgctaatacatacatcagaggatgtactttcttaatacgaccagttgcaatcattgtgattggatataagatgaaaccaagcgcgataccatctgatatagaataggttaggggcataccaataacaatcaaaaatgctggtgctgcgatagccaaatcttcccaatcaattaagcgtaagtttttggccattaagacgccaactactactaacgctggtgctgtcacctgtgaagtaacaacagataaaagtggtgagaagagcagagcaaacaagaaaaatattccagtgaacacggaagttaatcctgagcgaccaccaactgcaataccagatgacgattcaacataagcagaagtaggtgaagtaccaataacggcacctactgtcataccaaccgcatcagccattaaggcacggccagcacgtggcatttcattgtttttcatgaagccagcttgtgtggccaagccaatcattgtaccagctgtgtcaaaaaaagtaacaatcaagaaggtaataacaactgtgactagttgcagagaattaatatcaccaacatgcataacgccagcaccaaatgtaggtgcaagtgagggagcaggtgaaataatggcagatggtaatttgattagaccggttagaataccagcaagtgatgttaaaatcataccaatgaatatggcagccggtgttttacgactcatcaatatgaaagtaacaataattccaaaaattgataatagtgatgtaggtgatgacagatgtcccaaagataccatggtgtctttgttagctacaatcagccccgcatcatgcaatccgataaaagcaatgaatagcccgattcccgaagcaatagcgagttttagattttgtgggataatattgatgattttctcccgaattttgaaaaacgttaaaactaagaaaatcaatgcggctacaaacacaccagccatagcagtttcccattttacgcccatgccaataacaacagaataagcgaagaaagcattcacaccaagccctggggcaatagcaatagggtagagtgcaacgacacccatgaagatagttgcgacagctgaagcaattgctgtcgctgtgaaaacagcgcctttgtccatacctgctgcacccaaaacagtagggttaacaaataagatgtaagccatcgacgcaaaagtagttaaaccagcaataaactcggtccgaacacttgtgttgagttcgtcaagtttgaaataatgtgcaatcgtagacatgattgcctcccaaatatttagttacgaataacgtacaatttaattttagcagtcatttactaataattaaattaaaaatgagaaaataaaagatgttttcgcgaataatagggaaaaacagcaagtgaaagcgcttaataaacgaacgaaacattataaatgttcggaattcaatgaaatatgctgttcttttagcattttaacggttttgagataagctggaatcatgaccagaacagaacctgtccaagctaacatattggccaagctggccccaaaaaatccgaaaggtccaactaaagtaattgctgctactgtccgcataactaattcagcaataccagcaaaggtaggggttctagagtcattgagtccttgcaaaacatatcgtatgataaacaaagcggatagtatatagtagaaggcaccattagcccagaagtactgttgtgctaatgataatacacgatgttgatcagcaccgacaaacatagacacagcaacatgaccaaacataatttctaaaatacccataaacaggccaaaccccatgctcataaatagcgcatgtcttacaccgattaaaatgcgttgatattgtttggcaccatagttttgcgcagcgaaggttgccattgttataccaaatgacatcataggtagtgtagccacttgatcaatacgttgcgcagccgtggttgctgcaactgcgtctgttcctaatgtattcaatgcaccttgtagaactaatgagccaatcgctataattgaactttgaaagcccataggtaggccggcgtgtaaatgagtgcgaatgtcttttgcgtcccattttaaatcgtcacgatcaacacgaagctgggggacaaatctataaatgtgccaaaagcttagaatagcagagactaattgtgcaataacagttgcaatagctgctccagcaacaccaaaaccaaggcctaaaatcaaccataattcgaggccaatgttaacaaacataccaacaaccaaataaattaatggtgagcgagaatcacccactgcacgcagggcattagcggtgacattgtaccccatcgtagcaaaaataccacctaagatgatactaataaatgtgaatgcttgattcaaaatgtctggtggggtttgcatgattttaagtagtggatagattaggataaaactcaccacggtaacgattacagtgactattgctgatacgataattgttgatgccatacttttgcgcacaccagcaatatcacgagcaccataacgttgcgctgtaataattgataatccagaagtgaatccttgtacgaatcctataactaaaaacatgattgaaccagttgctccaacagcagcaagagatttcacaccaagtgtttgcccaacaatcagcgtatcggaaaagttatataattgttggaaaagatttccaattacgagtggaattgtaaaaaataaaatttgctttgcgggagttccctgagttaaatcacgcataatctctccaatatagataaaaatgtcttgaacatatattctaaacgaatagtggttatttgactagggttttgttctaaaatttataagaaagacatctgtttgtaaaaggctggatacactaggttttactaagatttttttcatgtcttttgaattaaattcggagataaattaaaatatcttcgagctgacatcgtcgataattgatgtttcgaataatgatataatcatactaatattaaaaaatgatcatttgtgagcaatccaatatttgcttacgtagctttaaaatgattgaaacgatataataggaagagtataaaaaaggagttgcatatggctgctaaacttgtgttagttcgccacggagagtcaacagcaaaccgtgacaatgaatttaccggatggactgacgttccactgaccttaaaaggggttagacaagcgaaccgtgttggtgaagttttgaagcgacatggcttgcaattcgatgtatcatttacttcttttttaaagcgcgcaatcataactgacaatattatattagaagaaattgagcagttgtggttaccactccataaggcttggcaactcaatgagcggcactatggtgcattacgtggcttgaataaagattatgctcgtcaacaatatggcgcaaataaagttgccttatggcgacgtagttatacggctacgccaccactactagaacacgttatcccagatagacgttacccggaaggcttagaaccacgtggtgagagcttgaaaatggccagtgatcgtcttgttccttattggcattcagaaatcttacctcagatacagcagggtaaaaatgttttaatcgtcgcacatggtagctccttacgtgctttagtcaaatatatagagcatattagcgatgaagacatagacggtcttgagattgacaatggtgaacctattttgtacgagtatgaagaaggatttagtgagaggatttatttagaatgaatgatagaacatgggctcgtgtgaaaaagtatacggagctacaaggcacttctggtcaagaacacgctattcgtcaatctttccgttctgatttggaaccattggttgatacaatccaccaagagggacttggtggtgtttacggtgttaaagaaggacaaggtccacgtgtaatgtttgcagcgcatatggatgaagttggatttattgtgaaagatattctgcctagtggtgcacttaaagtggccgcccttggtggatggaatccagcagtaattagttcgcagagatttactttgttcacaagtaaaggtaagtatcctattgtttcaagttctgtgtcaccacacttattacgcggcagcgctcacggcccacagatgccaaccgtagaggatattttatttgatggcggatttttgaacaaagatgaagcgtggtcatttggtgtccgtcctggggactttattgtgccacaagtatcaaccgttatgacagcaaataaaaggcgcgtaatatctaaatcatgggataatcgatttggacttgtgacaatattagacgctttggaagaactagaaaatgttcagacacccaataccttgataatgggcgccaatgttcaagaagaagttgggctacgcggtgcacatggcgccgtcaatttactgaaaccagatatttttttcgcagttgattctagtgctgcagatgatacttcaggacagaatggacaccaaggaatcctagatcaaggaacgttattacgtgtttttgatccaactgttgttatgccactgcgcttaaaagaatttttgttatctgtggctgaagataaccatattccttatcagtactttgtttccaagggtggaactgatgcagcagcagctcaaactgagttaactggtgtaccagccgttgcattaggtgttgcttctcgttacatacacacccaccaaacagtttggtcaattaaggattttgaagcatctaaagcatttgttgtggccattgccaaaaatttggatgatgcaaatcttaaaactattatgggcgattaatgtttaaaaaaatcagaaaattagattattggattgcggtaccatttgccatactcagtgcgttgggtgtagtaatggttttttcggcgagcttaacgaattcagcaatgctaaacttttacaaacaacttctttttgtttttattggttggattggtgcgtttactttatttcattttaatattaacaattggcgcaatgaaaaatggataaaggtgatgatgtttggtataattgggcttttaattattgccagaataatgccagcagttaatggtgctcacggttggattccactggggattattactttgcagccggctgagtttttaaaattagttttgatattatactttgctgatttttttgctaaacatccatggcaaccacacgttaaattaccacaacagccaattagccaactcaatgcttggtttttacctttttcatctctatttttattatttattatgccagataatggtaatatgattattgccgccatcattatgctaaccattgtacttgcagctggggtgtctaaaaagattaccgttgcctggtttgctatcgctggcattggctttggacttttacagccaatcattaatttgatcgataaagtattccatctgaccggtagtacgcattatggtattttaagattaattaattttgttaatccttgggctgacccagatcaaagccgtcaactactatacggttattacgccatagctcatggtggcatgtttggtgttggtttaggaaattctctcataaagccatatctacctgaatcaaatacggattttattatggcagtaatgacagaggaactaggggcagtagtgactgtaattgtgttaattttactattaataatcattacgcgccttattattttgggcattagacaaaaacgtcaatatcaacgattagtcatgtatggtgtagctaccttattatttatccaagcttttgttaatttaggtggcgttattggtgtgttaccaataacgggtgttgtttttccatttatttctggtggtggatcatcatatatagcctttagcgctgccattggtctaacgttgaatattgctgcgcaacagaagaaaaaaccagtcattcatccaaatgatacagtggccagaaaggattatcgatgacatttcaaatacaaccacgccgtgcaatttatatctatatcaataatataaggcatgcacaacagcttaaaaagtttggtcaaatcacgtacatatctcgcaagatgatgtttgtgggtctatatgtgaatgatgaaaatgttgaacaattagttgaaaaaattaagcaatacaagtttgtaaaaaaagtcgtcatgtcgccacgtccggaaattaatcctgatttagacaatttgcatgatgatattttctttgaaaattatgatgaaggaggaaatacaaactaagagtttgtatatcgtataatcatgcgggtagtatcaggaagatttcgaggaacacgccttgaagcagtcaatggcgacaaaacacgtccaacgacggataaagtgaaagaagccatgtttagcatgttaatgccgtatttagacggcggggatgtacttgatttatatgcaggtacaggaggcctgagcattgaagctgtttcaagaggtatgatgcatgctacgttagtagatcgccaattccaagcaattaaggtcattcaagagaatattgagaagacacaccatgctgatgagtttacggtcctaaagtcgccagcgcaacaagctttgcttaattttgtagccaattcaaaaaaatttgatttgatttttttggatccaccatatgctaaagaaaccattgctgcagatatgtcgtttatggcagaaaatgggttattaaactcgggtgctattatattggctgaaagcaacgatgaggcaaatttaccgaatgaaagtgatgatttctcaatcattcaacagaaacattatggtataaccgtagtgacgatatatcaatatgagggctaaattatgagtatagcagtatttcctggtagttttgatccgttaaccaacggtcatttagacattattaaacgtgctagtggtatatttgaaaaagtaatcgtaggtgttggtaataatacaagcaaagcggcgctgttcacaccacaagaaaaaattacattaattagtactgtcgttaaagatttgccaaatgttgaggtagcaatcatgaagggactaacagttcaattcatgaacgaagttggtgctaagtatatcgttcgagggcttcgaaatggtaaagatttcgagtatgaacgtgatattgccggaatgaacagtgctctggcagatgttgagaccgttttactacttgcaaaaccggaaaatcaaaatatttccagttccatggtcaaagaaattggtagtatgggtgctgataatatggtaaagtttgtcccaaaggccatagttgaagcattaaaggagcgactgaatgcgcaaaaaaagtaaaatagttcttgctgttgcatcccttttagtaatagttggtatcgtagttggcgtttggccgttgaacggttacattgagtcacctggtgaagcagacgacttagcacagtttgttaaaattgatggtaaaaaggatacatcaaagggacaatacagaattacatccgtttatttgtcccaagcgaatggatttaagtatttacaaactaaaattaatccacacctgtcgtatgcaactgcaaaggaagttactggtggacaaagttcagctacatttagtaaagtacaagatttttatatgcaaagtgcaattgccaacgctgagcaggtcgcctttaaaaaagcgaataaacctattacgacaaaatatcgtggtatctacgtactgagtgtctcttctaaatcccatttcaaaaagagtatcaaagtaggagataccatcactgcaatcgacggtcatcactacgaaaactcagatagctttattaagtatttagccaataaatccaagggaacgaaagtcactgtcgactacacccgggatggtaaaaacggccaagcaactggtgatacaattaagctcgctgggaccaagacggcagaatacccaaatggccgtgctggaataggtatcgtgctgacggataatgtggccgttacaacaacgccaaaagttagtgtcaatgccggccaaattggtggaccttcaggcggcttaatgtttaccatacagatttatgatcaattgactggtgatttgttagctaaaggacgtaatatttctggtactggtacaatgagtgctgatggttatgtgggtgagattggtggtattgataagaagattatggctgctaaggcagccggatcaacagtattctttgcgccatatgtaaagccaagcaaagagttactcaagtatgaagagcaacataaaactaactacatgctagctcgagatacggccaaaaaatatgcacctaaattaaaagttattcctgtgcaaacatttgatgatgtcatcaattatttgcaaacagggaaagtaattaagacaactgacagtgtgaaataaagcttatctgctatggtaagcttttttattttgaaattcgtactatgaaagtagagggattgaaatgtcagacatgttagaaattgtaaaagaaaaatactatgagtataaaatttggatattcattattttatttattctcgctgctattacttattgtgcatattctcatcagaccaaagaagtaccgcagacatcattatcttcttcaatagcaagtacaagtgatgtaaagaaatctgaatctgacgacaaaaatagctcaatcgtaatggttgatgttaagggcgctgtcaaaaagcctggggtctacaacattactagttttgcacgtgtacaaacagccattgcacaggctggtggaaccctagaagaagctgatatgcagcaagttaatttagcccaaaaattgacggacggacaaattgtgtacgttcctatgagaggagagacatcttctgctcctgtaaacaacggtagtacgtcagcagtgactacgacagataatgaagttattaatttgaataccgctacggtagtggaattacaaacattaaatggaattggtgtcaagaaagcggaacaaatcattgcatatcgtgaagaacacggtggatttaaatctattgaggaaattaaacaggtttccggtatcggtgaaaaaagatttgaagctttgaaagataaagtgactgtttaatatggcgcggattttaatgtttgctagtttgttgatagcaagtttaactggcattatctattattcatgtgcagttacttggttcctttttacttttatggtcgtattgtgttcttggcaacggcaaattgattttttgttcaaaatcttactgttgacactaccttttatggtttattttatttacaattcgcattgtttacagcaacaagtcaatcaaaaaaatgataagcaacatcatgtaagaggtatcatttttccagatgatattcaaattgatggagcaaatctcaaggcaacggctcagttagataaccatgagaaagtcaaattgtattggctttttccagatgaaaagataaaaaacatgtggcttgaaaacaataaagtcatttgttttcaagcagaagctgaattaacgcgtatacctgggccaactaatttcaatcaatttgactctcaaaaattttatttaacaaagtcaatcacacatcaaatcaatatcaaatcatggtatacggaggtagccaaaccgtcaactttactacaaaaaattagatatcaactccatgaatggcatagcgtcggtatccataatgccgagcggcttccttctccgcttagtgcatatgcagaggctttaattcttggaacgacacctcattccttatatgaagataatccaggagtacaaacgttagggttaattcacttattcagcgtgtcaggatttcacgtgactttcttaatgacattactgatgcaaatatcaagaaggatctggttgccaaaagaatatactatattggtgttgagtataatactgattgcatattttatatttgcgggagaacccgatgtattaattcgttctatcatttcaggagaattaatattgttaaaggatttaacaaataagaagataaaagctcaggttatctggtcgttgagtctgttgtttagtttagctatggtgccgcaaattttattgacgctaggaggacaactgtcatttgccttaaccttttgcttgacatttgcacagaaactaacattttggcaaactaacattttgatgagcttagttagttttccgcttattattcaacaacaatatacatggcacattctgcaaacatttatcaattttgctgcaattcctatttttggtacagtaattgttcctttggttatgataggtttttttggtcaatatattccatttttaacatatataacaaacctaatcatccggtattttgcttatatggtagatttatgtggaacgttaccaggaaattttgtggttggtaaaatacctaacgcactagctgcaatacttttgtttttggctttagggatgtttgcgcgtgaagccaaaattaagcatatctcgagaatatcgtggcttgtttcctttagtgtagccatgattttcgtacatctcccatatcatggcgaatttgcaacttttgatataggacaaggggatgcagcagtgattcgtgaaccgtacaataaaacaattacgttaatagatactggaggaaaagtaacgtttggcgaacagccagcatggcaaaaacagaagtacttccgtaccaatggcgagacggtaattgttaattatttacatagccgggggattagtaagattgataacttggtcttatcacatcatgatcaagaccatatcggtaatgctaaagtcatattaacaaaaatgaatgttaaaaatgttattattccagctggaatgatgcaacaatcgtcgtttaaaaccgaaattaaaccatatcttaggtcagcacaagtaacagaagttaccaataatattcaagtatcgaaactaccacttcaaatagttcacccgtttaaaagtggtcaagcaaaaaatgaggattgtatcgcgttatttggccatattggtgggaaaaatattttcactgctggtgatttagaccaatcgggagaaaaacagattgcaaatttctttccagatatgcatgttgacatcttaaagtttggtcatcatggttcaaaaacatcgacaaatcctgaagttatcaataaatggcatcctgaaattggcataatatctgccggacgaaacaatcgctataaccatccaaataaagaaacgcttgaaacagctcagaataataaaatgactgtttttaatacacaaataaatggtatgatgtgttatgaatattcaggattaaacggacattttaaggtaaaaataccccatgaacctaaaacaactacaacagcaaattgaaaataatgccatggcaaacttttatatcgtgacaggagaagaagaaacattgctaagccacgcaaaatcaatgtttaagggattagttgatcaagaagatcgtgacatgaattattcccagattgatttaaccgaacagacattggatgtagtaattaatgatgctatgtccgtgccttttttcggtgatcgtcgtgttgttgtggtcaaaaatccacaatttttgactgctacaggaaaagttggggatcgtgatcaagaattattattaaaattatttgatcagccagtattacaaaatattgttgttttttttgccaatgacttaaaattagacaagcgtaaaaaattagcaaaagtccttctgaaaacggctgaaaatatttctttaccagctcttaacgagcgccaggcgcaacaggctatcgttcaacaactagatcagcgctcgtatgccatagaaccagaagcacttcatgaattaatgcagcgtactaatgcccagtacacagatatgaaaaacgaattgcctaaactaataacctatgcggaacagacaaaaaaaataacactagacgtagtatcggcattagttcccaagacactgacagctaatgcgtttgatttggtagacgcagttattaaacgacgacctcaagaagcactaaccctttatcatgatcttttacagaatggcgaagccccgttgcgattaaatgctgttttaactaatcaatttagattacttttgcaggttgcagggttgtctgggaatgaccaagacattggggcgcaactcaaggttcatccttatcgagtaaaattagccaaagaagcattaaggtcttatccaccacagtttgtacgaacagggtacctaggtatgattgatatcgaaacacaattgaaatccacatctcaagatccagaacttttatttgagcggtttattttaaaaaattttcagtaatattttttattgaataagaacacttgttcctgtgataaaattatagtatgccagaatttcttatcgcagcagacaatagaagaattattcacgttgatctagatgccttttatgcccaaattgaaatgcgtgatcatcctgagttgcgtaatctgccattgatcatttcgcgtgatcctattgagtcaaacggacgtggtgttgttgcgactgctaattatgccgccagaaaattaggagtgcattcagcaatgagcgctgccgaggccaaaagattagcgccagatgcatttttcatgcgacctgattttcagaaatataagatgatatctcagcaaattcatcatatttttcatcagtatactgataaaattgaacctattgcatttgatgaggcatacttagatttaacagatagcgtactcacgggagcgacattagcggcaaaaattcgtcaccaaattctaaaagaaacgcagttaaccagttcaattggtgtttcgtacaataaattgttggcgaagttagcatcagaattcaataagccaaatggcgttactgtaataacaaaagataatgcattagatttcttggcaagattaccaatttcctcttttcgaggagttgggaaaaaaacacaagaaaaatttgcagtgctgggtgttgagaatggcgcacaattgcgcatgatacctcaagaaacgttacgagctcaatttggaaaaatgggtgaacatttgttttggcaggctagaggtgttcattttggcgaagttcaatggcatcgtcaaagacaatccgtagggaaagaagaaacctttgatcaatttgtacaaacaagagatgaagttaatctagaattcaaaaaattggctgtggaaattgttgaaatcatgaaaaataagaaattagtaggacgtacgctaaatataaaaattcgtgacagcgactttaatactatcacacgttctgtaactcaaagtgtgcctttcaaattagaagctggaagtatagtatctgtagcgcagacaatatttgatgagaatatgaatgcggctttttctattcgtttattgggaatatcacttagtaacctacagtctagcggatttgaggaaataacgctgttttaatgttacaataatagaaaataataattagaaagtataaacatgtcagtaatcgaagaacaaatattagaacagatcaagcgttacgatacaataattattcatcggcatcaacgacctgacccagacgcttttggttcacagttgggtttgaaagaaatattaaaagcaagttttccagaaaaaaagatatatgctgtgggcaaagaagttcaaggattagcatggatgaatgaagatgacaatttcatggatgttatacccgatgctgcttacaataaggctcttgttattgtaactgatacagccaatgcaccgcgtgtagatgaccaacgctggccagatggtttagaagttattaaaatagatcatcatccaaatgatgaatcatacggggattggcaatgggttaaagatggtcactccgctacaagcacaatgatttttgagttttatgaaaaacttaagggtcaaggattggtgatgaccaaaaaagcagcgcgcctattatatattggtattattggagacacgggtcgatttatgtatagtatcgattcagaaacgttccgtgtggtgtcagaactgtttaagtatgattttgattatcaagaaattcatcatgcgatggcaaccatttcggaaaacgcagccaaattgtcaggctatgttttgcaaaacttaagcatactgccatcgggatttgcttatgttattttaactaaagaattgttaaagcaatttgacttgaaagatgccgggacagcttttgttgtaccattaccatcaaagatagattgtgtgaaatcatgggctatttttgaagaacaagacgaaggaaactatcgtgtcagactgcgctcacgaacaattgcaattaataagattgcaaaccaatttgagggtggcggtcatccaatggcttcaggagcttgggcgcaagatcaaggtgatatagatcgcttaatcaatatagttgatagtgctcttagcgagaagcaagacgcagaaaaggaagattgatggctgaaaaagcaaaccaatttggacaatttaatttaaaaaaggaagttattgacgcattaagtgctattggtttttatgaaccaactgctgtgcaagcaaaattaattcctgatgttttacaaggacgagatgtggtcggacaatcgcaaactggttcaggaaagacgcacacatttttgattccaatcttgaatcaattagagcaggataacgaatacgtacaggcagtaattacgacaccgtcacgtgaattggcagcgcaaattaccaaggcgatgaaagaattttctaatcagctaaacactgatatttccatttctgagtttgtcggtggaacagacaagcaacgacaaattaaacaattggaaaatcaccaaccacaaattgtcattgggacaccgggtcggattaaagatttagtagagtctggatcattgaagttacatgcagttcatacgcttgttgtagatgaagctgatatgacgttagatatgggatttttaaatgaagtcgattatattgcaggtgcaatgcctgagggtcttcagacattggtgttcagtgcgacaatgccagaaaagttgaagccattcttgaaaaaatatttagataacccacattttgaagctataccagtgtcaacggtcattgccgatacaattgacaattggttattagctactaagtcaaaagataagaatgacattatttatcaagtattaactattggtaatccatacttagcattggttttcgctaataccaaagagcgtgcgaaggaaatttcgagttttttgcgtggacatggtttgaaagtggccgaaatacatggcgatattgaaccacgtgaacgtcgacgtgtgatgaaagcgatccaaaacttagaataccaatatgtcgtggcaacagaccttgctgcacgtggtattgatattgaaggtgtttcgcatgtcattaatgatgatatacctgccgaattagaattctttgttcaccgtgtgggtcggacgggccgtaatggtttgcctggattagccattacgttgtatggtccagatgaagaaaatgaagttgctgaattagaagccttgggtatcacttttaaggctaagcaaattaagggcaatgaaattattgacgttaaggatcgaagggctcgtgttcagcgagtagccacaaccaaaaaattggattcaactatggttggtatggttacaaagaaaaagaaaaatgtcaagccaggttacaaaagacgcattaaaaatgcaattcagcgtaaaaatcaaatggatcgtcggatatctcaacgacaagaaatgagagcaacacgcaaagcaaacaaacaacgtggagaacattaaaaaaaggacttggaaatttttccaagtccttttagtattcaaggaagtaggttaattacttaacgtacttagctaaacgtgacttttcacgtgaagctttgttcttcttgatcaaaccttttgagtaggcgtgatcaatagctgaagaagcagccttgtataattctgctaagttgtctgtaccagcagctgcagctttttcaaacttttttacagctgtacggtaagcgctgagttgtggttcgttacggtcgtgttgcttcttagtaagacgaacacgttgaattgctgattcaataacaggcatatgtcttttctccttaaatttgatacgaggttttcaagtaatcctaagattaacgacgcaaacctaagcgttggatcaattcacgataacgttgaatatcagtattgcggaggtaacgtaataagttacgacggctaccaatcttcttcattaatccacgttgtgagtggaaatcatgcttgtgagctgccatgtgtgtgttcaactcgttaatatcagcagttaaaactgcgatttgtacttcagctgaacctgtatcgccttcgtggcgggcgtatgccttgatgatttcgttcttacgttcttgtgtaagtgccatatttatatccacctttctaaaatgtcgccagagactgcgtaaagcgatggtgagccgctcaacaaagttactggtcgtgttgtttgtacaacattcttaattatacaggaataccattgaaatgcaaggcgagagattgacaaatatgtgataaaatggactagtatataaacactgaaaggaagtgtgcctacagaaatgtatgcacccgcggatatttatggccgaaacaacaatcacacgtgacgaagttgcccatgttgcagggttagccaaattagcttttaacgatgctgatcttgaccaatttacaacacaattgggtgatatcttgaatatttttgatacgttgagcgaggtaaatactgatgatgttatcccaacatactcagtaacggaaaatgttaatcatttgcgtgaagatgtcgcaaataactggaatcaaaaacaagaacttcttaataatgcaccacttgaagctgcagatttaattaaggttcctgcaattttgaatggtgagggggaataacatgacaattaattattttgagcatgatttaacttctttgcacaatcagttggtaaacaaagaagtaagtgcggtagatttgacacgtgcatcgcttgataacatttctaaaactgatgataaattaaatgcatttattagcacaaacccagacgaagctatagcacaagctcaaaaaattgatgaaaaatctgatttttcgaatgtcttgacgggtctccctttgggattgaaagataatatggcaaccaagggcattcaaacaacgggtgcttcgcatattttggaaggttttaagccaatctataatgcgacagtggtggaaaaattgcaaaacctaggggcggtttctgttggaaagactaacatggatgaatttgccatgggtggttcaacagaaacctcatactataaacaaacatcaaatgcgtgggatcatagtaaggtgccaggtggatcatcaggtggatcagctgcagcagttgccgctggacaagtgccatttgcattagggtctgataccggtggttcaattcgccagccagctgcctttaatggaattgttggtttaaagcctacgtatggtcgtgtttcacgttggggcttgtttgccatggcttcttcacttgatcaaatcgggcctttcacaagaactgtgaaggataacgcaacagtactaaatgctattgctggtttcgacgagaaagactcaacttcatcgcagcgtgaagtgcctgatttcactgcaaagttaagcggtgatgttaagggcttaaagatcgctgtgccaaaagaatactttggtgaaggtattgatccaaaagttgccaagcaagtcaaggctgctattgcacaattagaagcattgggagcaactgttgacgaagtaagtcttccacacactaaatacggtgtagctgcatactatattatcatgtcatcagaagcatcatctaacttacaacgttatgatggtgtgagatatggtttccgtgccgatgacgttaaaaacttggaagatttatatgtcaaaacacgttcagaaggttttggtgacgaagtcaagcgtcgtatcatgttaggaacgttctcattgtcagctggtgcgtatgatgctttctttaagaaggccgctaaaattcgtacattgttgattgaggactttaataaggtttttgaaaactatgatgtaattgttggacctactgcgccaacagctgcatatggtcttggtgaagaggttgatgaccctacagcaatgtacctggcagatgttttgactatcccagtaaacttagctggtctacctggtttgtcagtcaacgctggatttgttgatggattgcctgtgggcttgcaaattattggtaagccatttgacgaacagactgtttatcaaacaggatatgcttacgaacaagccagccgtttgtttgaacaacatcctgacgttgcgaaagaatattaaagaggaggggcacacatgggaactggaaattttgaaacaacgattggacttgaagtccacgttgaaatgcaaacaaactcaaagctgttgtcaccttcaccggttcactatggtgacaagccaaatactaatacaaacgtaattgactttggttatcctggtgttttaccggtagcaaacaaaggcgcattggaatatggtatgcgtgttgcgctggcattacacgcacaaatttcgccattgattcgttgggaccgtaaaaactatttttaccctgataaccccaaggcttatcaaacaacgcaatcacaaacaccaattggtactaacggttacttagatgtgacattggccgatggaacggtaaagcgtgtccgcattgcagaaatgcacgttgaagaagatgcgggtaaaaatacacacggatctgatggttattcttatgttgatttaaaccgtcaagggacaccattgattgaaattgtttcagaacctgatcttgcttcaccagatgaggcctatgcttacttagagcagttgcgccaagttattttatttacaggtgtttctgaagctaagatgcaagaaggtcaaatgcgtgcagatgtcaatgtatcactcagaccatttggatcagatcagtatggaacaaaagttgaaatgaagaatattaactcattcaactacgttcgtaacgcattgatttttgaagaaaagcgacaggcagaggttttgcgttctggtggtgtaattcaacaagaaactcgacgctatgatgaaccaactaaatcgacaatcttaatgcgtgtaaaagagggagcagacgattatcgttacttcccagaacctgatttatctccggtggtcattgaccaaaaatggattgatgaagttgctgcagacttaccaaaatcatcgagtgaacgtcaagaagcctatgtaaatgacttgggaattgaaccttatgatgcagaagttttgacacagacgcttgctatgtctgatttttatgatgcgactgtatcttcaggagctgatccaaaacgcgctgctaactatctaattggtgatgtgaatgcttatatgaataagaatcaagttgagctgcaagacacgcgtttgactcctgagcatttagcaggcatgattaagttgattgaagacggaacaatctctacaaagcaagccaagcaagtctttgaagcgattatgattggtgaagagccagaagcctttgctaagaagcatggtctggttcaattaagtgatccagatttgttgttaggctggattactgaagtattggacaataatccgcaatctattgaagacttcaagggcggtaaagatcgtgctactggctatcttattgggcaacttatgaaaatgtccaaaggacaagcaaatccaagtgttttgaataagttgttgttgtcagagttaaaaaaacgataaacgttgaaaatgtaaactagtcaataagcgagatttttctcgcgtacatattgtaagctgaaaggaaaagtgtttgccggcatgaaacgagcaagaattatctataatccaacttcgggtcgagaggctattaaacgcgagatgcttgatatcctcgcagtttatgaaaaagctgggtatgaaacttcggcttttgccactacaccagaaccactgagtgcggcgaaagaagcaaggcgtgctgctgaggctggttttgatcttattgtcgcagcaggtggggatggaacaattaacgaggttgttaatggattatctcccttaacaaagcgcccgatgatggcagtcataccggcgggtacaaccaatgattatgcacgtgcactaaaattacctcgcgatgagccattagaagcagcaaaagtaattttgcaaaatgaaaccattaaaatggacataggcaaaattgaaaaagataacggaattaagtattttatgaatattgccgctctaggaactattagcgaggtgacgtatgcggtgccttcgttgatgaaatcattatatggctatttggcctatttggttaagggagcagagctgattactcgagttaaagcagttaatgccaaggttatatttgatgatggtgagtattcaggaaaaacttcgatgatctttttggcactgactaattctgtcggtggctttgagtccatcgtcccagatgcaaagttagacgatggtcgttttacgctcttaatcattaaagaagctaacttggcacagatgctacagatggtggcgcagatgattaatggcggtaagcatattgataatcctaagttaatctacaagaaaaccaacaaagtagagatcttgccactagataatgaccaaatgaaagtgaatttagatggcgaatatggtggtgatgcgccaatgaaatttactgatttacaacaacatattgaatttgtagccaatcgttcaggcatgtcagaaaattctgtaagtgttgctaaacgtaaatttgttgaagaagccgaaaaactagatacaaagtaacatcagtaaggcgctaattatggtgccttattctcattttaaagtgcgtgtcaaaaggcgcaagaaagaagcaaatcattatggcgaaagctaatcgagtatataaaaccgaagcaccagtagctaaaaatcaggaaattgaagcaaccgtgattgatattacatatcaaggcatgggtgttgttaaggttgataattttccgatatttgtagttgatgctattccgggagaaattgtccgcgtgagtgtcacaaaagtactaaaaagctacgcatttgggcgtgtaacaagacgtattcaggaatccgaaaatcgcgttcaaaatgccaacaaaatagcaattaccacaggcattgcaccgctagccaatttgaaatatgaggcacaactggcgtttaaacagcatcaaattgaagaattatttaaaaaggttaatgtagatgttgatgtggcgccgactattggtatggaaaatccaacagggtaccgtaataaggcacaagtacctgtgcaaatgataaatggtaaattagaaacaggtttttatcgtcgtgggtcacatcgtttagtgccaattgaagatttttatatccaagatcccaaggttgatgaagcagttcgtattacgcgagacattttacgtgaattaggtgtttccgcgtatgaagaagaaactaaaaaaggcgttattcgtcatattatggcacgacggggctattattcacatgaattaatggttgttatcatcacgaatactaaaaagctgcctaatagcgacttaattgccgaaaaactcagtgcaaaactacctgaattaaagagtgttatccacaatatcaataatcacgataccaatgtgattatgggacaatggaatgaaacgatttggggtgaagacgatattcacgatcaattaatgggtaaagactttgttattgggccaaactctttctatcaggtcaatcctcaaaccacttcgaccttgtatgcgctcgcagctgaaaaggctaatttgaaaccgactgatgttgttgttgacgcttattctggtatcggaacaattacgttatctgttgcggataaagtgaaaaaaatatatggtgttgatgttgttgaaggagcaattgaagatgctgaaaaaaacgccaaaaacaatcaaattacaaatgccgaatttgtattggctgacgcaccagagcaaatggcaaaatgggcggatgaaggattaaagccaaatgttgtctttgttgatccaccacgcaaagggttaacacaagaattgattgatgcagttaaagcaatgaatcctgaaaaatttgtatatataagttgtaacccagcaacacttgcgcgtgatgctgttcaaattttggctgcaggatttgaaatcgaaggtgcagttcaaccactggatcaattcccacaaacaactcacgttgaaagcattacagttttcaaaaaagctgaaaattaataatttagatccaaacaatatgcggtacgcatcactatgagattgtcctttcatagcagatgtgcgctgcatttttcagtgtgtcacagaaatgtttatttgatatgttaaaatgtagtgtatagaaagaggtattcaacatggctaaagttgctgaaacaccaatgatggtgcaatatcatgagattaaaagtcaatatcctgacgcattcgtgttttatcgtttgggtgatttttatgagttatttgaagatgatgcagtgcttggcgcaaaattgttggagctaacattaacagcacgtaataaaaattctgaaaatccggtaccaatggctggcattccacaccatgctgctcagaattatattgatattttagttgatcaaggacacaaagtcgctatagtggagcaaatggaagatcctgccactgcaaagggaatggtgaagcgtgacgtggtgcaactcattaccccggggacaaagcttaatagtggcatgggcaatgataagcaaaataattatttggctgcggtgttaccacgagataatcgttattttttgagttacattgatttatcaacgggtgaattaaaaaccacaacactaaagcgttttagcgatgtaattgatgagctcagttcacttgaagttaaagaaattgtgttattaaaagatgatgaaacaacagaactagggatagctaataagcttgctgaacggggattggtaatttctactcaatctgacgtaaatgttaatgctacagttagttttttgacacagcctttggtacatgaaaatgaagcacaagtaaccactattttattaaactatatatttgacacccagcgccgtaatttggatcatattattccggctcaaaattatgaacgcttggcttatttgaaattcaaccaagatacacggactaatttagatcttgtaaaaaacgcaaggacaaaaaagaaagcaggttccttacttggtctaattgatgaaactaaaaccgctatgggaggtcggttactaaaacaatggttgctgcgtccacttcgggatacagaagacatcaatgaacgtttagatatgattgaagcatttcaaaatgaattttttgtacgtggcgcgctacaagatcatttgaaatcagtatatgatttggaacgtttagcagctcgtgctgctatgggcacgatgaacgcccgagaattagtacaattaaagcgatcattatctgcaattccaggtatgaagtccgttctgtcctcaagccaaggtattttaaatcatgctagtcaacgactagaagatatgagtgatttagctggattgattgatgaagcaattgttgatgaccctccgattagcatccgtgagggcgatatcatcaatgatggatttgattcaaaaatcgatgaatatcgtaacgttttgagtcaaaatcagaaatggctggcacaattagaatccgatgagcgtgctgcaactggcattaattcattgaaagttaagtacaataaaaactttggatttttcattgaagtatctcgtgcaaatgttagtaagttagaagaagggcgctatgaacgtaagcagaccctgactaatgctgaaaggtttgttacgcctgaactgaaggagcacgagcgtttaattaacgaagcgcaactcaaaagaaccgagcgtgaatacgaattgttcattacgattcgtgagcgtgttaaagcaaatatttctcgtttacaaaagttggcacgacaggtagcgcaattagacgttctagcaagcttagcagatgttgctgacaataatcgctttgttcgtcccacatttactgacgataatataattaatattaagcagggacgccatccagtggttgaagcaatattagaagccggtgagtttgttgctaatgatgtgaatttggatcaaaatacggcaatgcaattgatcacggggcctaatatggctggaaaatcaacctatatgcgggagttagcgttgattgttattttgggtcaaatgggcagttttgttccggccgaaagtgccgtattaccaatatttgatcaaatatttacccgtattggcgccaatgatgatatggcaatgggtcaatcgacatttatggtcgaaatggcggaagccaacctagcattgcaagaagccagcgcgcactcattaatattatttgatgaattaggtcgaggcacggcaacttatgatggtatggcattagctcaagccatcattgaatatttagatgctcatgtacatgctaaaacattattttcaacccattatcatgagttaacggcattggcagacaaacatgaaaatattaaaaatgttcatgtgggcgctgttgaagatgaatcgggtgagttacacttcttgcatcagattcaacaaggaccagctgacaaatcgtatggcattcacgttgctgcactagccggattgcctgacgaattaattgcaaatgcaacaacaattttatcaggattagaaaatcaagaagcattagtacctgaaccaaaagcttcagggttgtctgagcaagtggcattgttcaatgtttcggatgttgatcctaaaacagaaacattatttcaaaaattagatagcatcaacatatcaaaaatgacaccgctagaagcattaaatgtattggcagaattacaaaaattgaggaagtaagacagtgcgcatacatgaattatcaaatttattagctaaccaaattgccgctggtgaggtcattgagcgtccagccagtgttgtaaaagaattagttgaaaatgctattgatgcaggggcaacacaaattgatgtcatcgtagaagaagccggtgagtcattaattcgtgttgtcgataatggtgaaggaattaacccagaagatgtaccgttagcttttactaggcatgctactagtaaaattagcaatcgacatgatttgtttaatattatgtctcttggattccgtggagaagctttgccgtcgatagcagctatttctgatgtaaccctgaataccactactcaagaagcgccaagtgggatcatgtatcatatcaaaggtggcaagcaagtttctgcaacgccagccaacggacggcgaggaacggtggtttctgttagagatctattttacaataccccagctagattaaaatacttgaaacggccgcaaacagagttgtctcgtatcgctgatattatgaatcgtattgcgttgtcatatacgaatgttgccttcactgtaactgctgatggacgtaatattttacaaacaaatggggatggtaatcagcaacgtgttatcgctgcgatatatggacgtgacgttgcgcaaaaaatgcgtgcaattaccggcgaagatgatgattttaatattacagggtttgtgtcattaccagaactcacgcgaggttcgcgggattacttaacgatattggttaatggccgttttattaaaaatttttccgtatcaaatgcagttattcgtggatatgggtcaaagctgatggttggtcgttttccaatgggtgtcatcaacatcaatacagatcctttattagttgatgttaacgtacatccgcaaaaagctgaaattcgattatcaaaagaagccgaactatcagcattaattattgatactattaaatcttgctttgctgatgaaaatttaattccagatgcttatgaaaatctatatggacaggctcagactaacaaaattgagccaccagcaccaaagcaagtagcaccatgggctaagccagatatggaacagactattgcgatcaatacaggtatagatagcaatgaagtggtcatcaatcaaaagtcagatttgatgaacgatgcagttaatgagtttactcaaaaatatgctcacgaacctaacttgccaatatttgatgatgaaataactgtgcaagtttctgaagatatatctagctataataagccagagatatcaactcaagaggagttagacatttcgccaaagaaaccgagtggattccccaacctagagtatattggacaaatgcatggtacgtttttgtttgctcaaagtagcgaaggattctatttgattgaccaacatgctgcacaagaacgtgtgaagtatgaatattatcgaaaagaaattggtcaggttggcacggataagcagcgaatgttagtgccaatcaccattaactattctgtagctgatatgttgaagattgccgataaggaagccgaattagaggctattggcttgacgctagaaccattcgggccaacaacagtaattgtccgtgaacatccaacatggtttgaaaagggccaagagactgaaacgattaaagaaatggttgattggatattacgagacggtaatttgacagttgccgaatttcgtgaacgtacagcaattatgatgagctgtaaacgctcagtccgtgccaacatgcatttaagcgacttacaagcccggacgttgatcgaatcacttgcctcgactgagaacccttataattgtcctcatggtcgtccagtggtgacgtcatttacactaactgaaatggaaaaaatgtttaaacgcattcaagattcacatgaggcatgggaggaatatgataaccatccatattaaccatttgtaacacattagtttttctagttacttcatattttttgggatagatttgttatcacattattatttaataaagtaaaaatggattaatttttcacttgcgtaactcaaaattattcgataaaatatgatttcaaacaattgatgggagaaattgtaatggcattgaatacaaaattaaatcaaacaaaaaataatgttaaaaaaactactaaaattattaaagacaatagtaagcaagttgttcaaaattcaattgaagacttcaaacatgatagtgttcctatggaacataagaagtaacctcttaatgctctttacataaaatctggtgatgatcttgtctcgaatatttattcacagcacatggctttgggaaaaaatgatttgtgcgaggcatatgcttttacaagcgcttacagttgcgttatacttatcagacaacatcgaatatcattcaaggaggacgctcatgtcatttgaagaaaagtttgataatgctaaagataaaattgctggtaaggcaaaagaacttgaaggaaaaattaccggtgataaagcacgtgaagtcgaaggtaagacccaaaatgttaagggcgaagccaaagatgatgtacaaaaggttcgagatgttgcccatgacgatgtcgatgccgtaaaagatgctttgaaaaataaaaaagataatccagaaaaataataagtttacaattgcatatcaaaaaggctggctagggaattctgatcagccttttttgtatggtataattagacttgcggacacaactgtcttttctatagggtagtttgaagagaaaaataaaaggaaaataatagagaaaaatagttgacatttggacaatatattttctatttactaggttctacaacaatggcttttaacaataatgatataattattcgtttacgttacgcactcaacataaaagatgctgatatgattaaaatttttaaatttggtggcgtaacaatagatgaagatcaattacacaacctattgacaaaacaagcagaagatacgaaacgtgatgagaaggtcgctacaaaaatacttgaatcatttatgaatggcttgattatttcacaacgtggtgaaaaaattggtcccgatttaaagcctgttccaccaacatttgatatggtcaacgaggcagcgataaataatgttgttatcaaaaaattgaaaattgcgatggcctatactagtgatgatttaattggtttcttaaaaacggcaggtattcaaatttctaatagtgagttaagtgcaatattgcgtcgaccggatcatcgaaattataaaccggctggtgatcgctatcttcgtaatattttaaaagggatggccatggagtaccgtcctgaggatgtcaaacgcacagcaagaaagtagtattgtgaacgttttcatatatgtgtacaattaagttagagacttaattataaggaggaaatatatggtagaacgtacttttatgatgattaaaccggatggcgtttcgcgtggcaaaattggtgagattattcagcgaattgagcataaaggctatgcgattaaagcgatgaaaatggtacaacctactcctgaattactagcaaagcattatgctgaacatgtgggcaaatcattttatccttcgttagtgcagtatatgacttcgggcccgattattgcgatgattggagaaggaaccaacattgtatcgggctggcgaacaattatgggaacgaccaatccaacactagctgcaccgggaactattcgtggtgatttaggtcgtgaatgggaaggggaagctgttatgaatatcgttcatggttcggacagtgttgaagcggccgaatatgaaatcaaattatggtttgcgtaatgcagtgtaagatgaatgatgtttttaatagttaaagtgaattgattaagcactcacgggaattgatttaaatccacttgggcgcttttttattttgttttttcaataatatattagcgatttaacataattttaaagaattacctaaagtttggtaaaatagtacatatggacttggagacaaaatttaatgcaattagaaaatattgaaatactagagaatcattcactagcaccatatgcttatacgcaagctggtggattggttgattatttagccatccccaaaagtattcatgaattgaaagtactggtgaactgggctaaagagttaggcatgcctgtgcaagtttttggtcggctatccaatttaatcgttcgcaatggtggtctacggggactatccatcttactacatgatttacgggacgtcgttgtggatcaaaataaaatcgtagcatcagctggtgctgatttaatttgggtaactgagcaagcgtttgaacatgggctgagtggtttagagtggggcgcaggaattccagggtcagttggcggagctgtattcatgaatgcaggcgcttatggggggcaagttgatatggttgtgtcatctgtcactgctttaatgccagatggcactctgcaaaattttgaaaaaaaggcattggaatttggttaccgaaaatctgttttccagagcaacggtggcattataattagtgcgacttttgaattgcaaccagatagttgcactgctatcaggacacgaatggatgaaaataattttaaacgtgctaataaacaaccactaaattatccatcgaatggctctgtttttaagcggccagaaggttactttgcaggtaaattgattatggattctaaattacaaggtgtccgccgcggcggtgttgaagtttccaaaaagcatgcgggattcatggtcaatatcgcacatggcaccggtaatgactatgaggatttaattcattatgtacaaaaaacagtgtatgaaaaatttggtgtgcatttagaaacagaagtcagaataatgggagagcgttaaggaatggcaatattagaattaattgtaatattaattgttgcggtaaccatctctaacattgtgtcgcattttatacctgagatacctatcagtttatttcagattgcgattggtctctttctagcactggtatgtggtatttacgttgaagttgattcagagtggtttatgctattgtttatagcaccattattgtttaacgatgcatggcgttttccaaaacatgaactttgggaattacgtgggccgattttaggtaattcaattattttggttatcttaacaacgttagtcggtggatttttaatgcacctattaatgcctcaactaccaaaatcagtggctttggccctagcggctgtgatatcaccaactgatccggtggccgtacaagccattgctcggcgtgtgaagcttccggaaaatgtgatgcatattgtttcaggagaaagtttaatcaacgacgcgagtgggttggttagttttaatacggcgattaaagccaccatcgcaggtacttttctaattggtgaagccattggaaacttcttttggatgactattgtcggattagctgttgggctaattcttggtagttttgttagctggctacgtgactcttttgatcgtgttggcttgaatgatgtggttttccatacggttgtgactttgttaatgccattcgttatttattgggttgctgaggacatttttcactcctctggtgtaattgcagttgtggctggtggcgttctatcgaaaattttgagcgatcagcatatgaatgcgcgttcacctgaaataaatgtggtcacagtacgtacttgggaagtatttgtttatttgctaaatggcacaatttttatcttactaggtattgaacttcctgctgccatgaaagatattgtgcgtagtacgcaggttcatacgggtatggccatcttttatggtgttgccgtttggtttatcatatttactattcgtacattttgggcttacggcacgcaaattacatatcatttaaaacataaggaacgcgccatttcttttagaatggcaatcatatcgggccttactggtgttcgtggtgcggttacaatggccgctgttctaaccgttccatcgactattgcagacggatcggcttttccacaacgtaatttactcgtttttgtggcggcagtagtggtgattattagtctgttggtggccacaattatgttgccaattgttaccaaacaacgaaccacacatgattttacacaaccagaagtgggcgaagttgaaacatcaagtacccatgaatctaaagttgatttaactgaggcacaagcaagaatattttccattcgaattggtatacaagttctccgtgagcaacaaaatgatcataatagaattattgtctatgaattaattggtagaaaacaacaaattattgaccagatttatcgacagttaaacaaaagtaatgatcataaagttaatattgaagatgatcgagaattgcgacgcgtcgcattagaagcgcaacgaaattgcttacgtcaactgctcgccgatgaaaaaatatctatactaacttattcttctcaaaatcgacgtttagatcgtctagagaatatgattgattctgataaacactatcatttatctacccagtggattattatattgtggcggcgtacgctaagaagtattcggatttggatttcggatgagtcaaccgaccaatttcgtgaagaaagttcaatggccactaaagaaatggccaaggaagccattcagtctttgtctgaatatatggaaaagtatacaggtgatactgtttcacatcgaatggaacgccaagcggcttataatttgattatattttatcgtaatcagattgagaaagaacgtcaccctgatacaccagaacaacgtgaactagatgatagatatcgaatggaattggaaatcaaagcattaaatgtggaacgtgaaacgattcaacaactttatgaacaagggcgtatttcaagacaagcaggcgtgaacatacgtcagtttatcaattatgccgaaacagctgctctagcaggaagggatgaggaatagctaagtatgaatattctactatattttacatttaataacctaatgcatgtcattgacatcgctattatatggtttattttgtataagctcattcaattcgtcgaaggaacccgcgctttgcagatattgtttggagtaggcttcgttattttggttaaggtagtgagctggtaccttggtttagtaactctatcgtggattatggatcaaataattacatgggctccaatagcagtggtagttattttccaacaagagattcgacggggattagaaagcttgggacgacgtttggtcattcgtcgtgctcgtgtagataattctaaagaacatcaactaattaagagtctagatgatgctttgcagtatatgtctaaacgacgaataggtgcattaattacgataaaacgtgatggtagtttagatgaatatatcaaaactggcataaaattagatgcctacattaccggtcagttattaattaatacgtttattcctaacacacctttgcatgatggtgccgtgattattgatgatgatcgcatcgctgttgctgcagcatacttaccattatcagaaagtacgcgaataccaaaggaactgggaacacggcatcgtgctgctgttggtattagtgaagcaagtgatgcaattacagtggttgtttctgaagaaacaggggaaatatcgattactcaagggggggatttacttcgcaatatggaccaagagtcttacatgaacttttttgaacatcaatttttggtgcaaattgacgaagaaaatgacaaacactggtggcaaaagattggaggacgttcaaaatgaaaaaaataggacagtctaaaatcgttaatttggtggtttccttagttatcgctattttacttgccgcttatgtttctagtacgaaacaaggtactgctaccaacaatggagggtcaacaaatttttcaacgttgattccagaaaaaagggctaccctaaaggtacctttaaatttacaagttgattcagataaatatgttgttatcggcgcaccgtcaacagttaaggttggtattgagggatcgggaccactggtgacagctgcacagagtcataatgacattcaagctagcgtagatttacgtagcttaggtgttggtaagcacaatgttaaggtggctttacgaggcgttaactcttccctaacatctacggtaacgccacaaacagtcacggtgacaatttcccaaaagaaatcggcaaaactgccagtgcaggttagtttcgataaaagtaagattgcgaccggatacacggttggagatacaacatcagatccaaaaaatgtcacgatttcaggacctaaggctaacgtcgaagctgtgagttatgtagatgccaaagtgtcacttgatagtggtgttaaacagtctgtctcacaatctgtcaaacttgttgcacgagataaagatggtaatgcagttgaggttaatatcagtgatccaacggcgaatgtcacgttagatgtagaacctgaagacagtaaaaaaatgaatttgagcgcaacaataaacaatggtgacagtgatgactatacgattacatttgatccaaaaacggtgacggcatatggttcttctgatatacttaaatcggtggacactattaatataccagtggatgttggaaatattagcaataaaacaacgcgtactatagagattcctacacaaacagggattgttgaatatagtgtttcaaaagtaaaagtaactattacaccgtcaaacaccagctcaacaagtagcagttcgacggggagcacgagcagtagctctagttcatcatcttcatcatcctctgaatcaacaagcagtacaagtagtagtactcaaagtagtgcaagcacaacatcagaaactaaaggacagtaaaacatgtcagaatttaatcttaaatatttcggaaccgatggtgtaagaggtgttgcaaataaaacacttacacctgagcttgcttttcgtcttggccgtacaggtggtgcaatattaaccaggcatgccaacgatgaaaacaagaaaccagttgttattgtaggtcgtgatactcgaatttcaggcgaaatgttacaacaagccattattgcaggatttttatcagttggtattgatgtgctgcggttaggcgttattactacgccagctgtagcttttctggttcaaaatttagaggcagacgctggtgtgcagattacagcttcacataatccggcagctgacaatggcataaaattctttggaaatgatggtttcaaattatctgaccaattagaatatgaaattgaacaattattagatgaatcagaagatacactacctcgtcccagtgctgatggattaggtgtcgttaataattatccggaaggcgttcaaaagtacctagaatttcttcaaaaaacaattccaacagaccttaatggtatgcgaattgctcttgatggtgctaatggcgctaccagcggtttattggcacgattgtttgcggatttgggaacagatttcgtaacattaggaacagaaccaaatgggctaaatattaatgatggcgttggatctactaatccagcggcgcttgctgaacttgtaaaagaaaatgatgtacaagcaggtctagcatttgatggtgatggggatcgattaattgctgttgatgaaaatggtgagattgttgatggtgataaaattatgtttatcactggaaaattcttaaatgaacaagggcgtttaaagcacaatgcagttgtctcaacagtaatgagtaatattggtttctataaggcgttggcagaaaacgatatgactagtatcaaaacagcagtcggtgaccgctatgttatggaagaaatgattaaatcggaccataatcttggtggcgaacagtctggtcacattatttttcgtgattgggcaacaactggagatggcttactaacggctctacaattgttatatgtaatgaaagagacgggaaagaagctatctgaactggcagctcctgttcatatttatccacaaaaattagtgaatataactgtcgctgataaagaagaaattcagcatgatcctgatgttattgccaaaattgctgaggttgaagtacagatggcaggggacggtcgagtattagtccgcccttcaggaacagaacctttactacgtgtcatggtggaagcaccaacgcaagagttagtggaaaagtatactgaatccatcgcaaatgttgttcgtgaaaaatctggactataaagcatacgattactactatgatctttagattgagtggctataacttttcgaaaagtatggccacttttttgatataatatactatagactacgctttaaaaggaaaataacgtgtcacaagacagttttaaatcatacattttaaaaaaatttaatatctcatttaatgacgaaagcttattaacagaagctttaacgcaacgcaactatttgaatgaacatccggacgaaaaaggtcgcgactaccagcgtctggagtttctaggtgactctgtcatgcaaatgattgttgctgagtatttgtttaagcgctatcctgactggcatgaaggtcaattgaccgaaatgcgtattgcaatggttcaaacaagatcatttgcgcatttctcacgcatggttcatttaaacgaaggtattcgtttaggaaaaggtgaagagatgagcggggcgcgggatcgcgactcattgcttgaagatatttgggaagcttttattggtgcattgtatctagatcaaggggcagatgtcgttagacaattcttaaatcaaacattatttgcagcaattgatacagacttttttgatcgttttattgattttaaaagccgattacaagagcgattacagaccaaagggtctgtggatattgattatcagaccgaaaaagaggaacaattatcagataatacccaattatttgaagcgagtgtctccgctaatgacaaagaattagcgcgtggtactggtaaatccatcaaagatgctgaaaaagcagctgccagagcagcactaaaaatactggaagataatgtcaacttatgaaactaaaatcacttgaaattagcggatttaaatcatttgctgataagacaatgattgaactaatgccggggatgaccggtattattggacctaacggttcaggaaaatcaaacatcattgaagcgattcaatgggtgatgggtgaacaatctgccaaagatttgcgtgggacaaagatgtccgacgttatttttggtggtaccgataaacgtggtgcgttgaatcgcgctgaagtgtcaattacttttgataattctgatcactatgtacaatctgattttaatgaaattcgaattacacgaaagttgtatcgatcaggtgaaagttcctatttaattaatggtgttgagagccggttgagagatattcatgaattgtttatggatactggtttgggacgtgaaagtttttcaataatatcccaaggacgagttgaaagtattttcaatgcaaaacctgaagatcgacgcggcattattgaagaagtcgccggcgtgtataaatacaagcaaaataaagaaaaggcgcaaaaagaattaacccagacaagtgataatttgtcacgtgtggcagatattattcatgagattgaaagtcgaattgatccattagcggagcaggcggcagaagcaacagattatttagctcaaaaaaaacgttttgatacgttagacaaggcgcgattggcatggtcaattcatgatcttaatggtcaaatatcatcaacgaccaaacaagtagaaacacatgacaaacgtgttaaccagacgaagctagcactagatgttgtcaataaaaaattattagacaaacgtcaagaacgtgttagtgcacaattgtcacgagatagcttacaggctacaattctagagtgtactcaaaaacgtgaacgtttgattggcgctaaaaatttaggagcacagcaaatttcaacgctaaatagagatgttgaaagtgctaaaaaacaagagtttgatttacaaaatcgtgttcggaaattagatgaacaaattagccaagtagaaaaacaaaaagatgggttacaaaaacaataccaacaattaaaaattagtcttggacaatttgatacaagtgtacaagttgagttacaacgtgaaatacaaagcaaaattgaagtaaatcgacatcattatattcaaacaatgcaggatatagctacactgcacaacacgcaaaaaaatgacgaaaagctattacagcagctagaaagtcgtcaaaaagtgttgtcagcacgtcttgataatgaaaacgaagagttaacagctattcaaagaacgtttaacaaaaaagtaccaaatattgatcatgatgatgtgaacattacagaacttgaaaaaaatgtagcagatttaaagcaagacattggtaatgaagcaaaaatatataagtccacagagcaaaattggtacaaggtattagatgaattaaacaaggtacgtagtcatcgcgatgcactcaattctttagacgagtatgctggtttttatcaaggtgttcgcgcgctgatgaagccacaaactttagaaaaatttagtggtattaaaggggttattgctgaattaatgaccgttcccagtcgttatgctttggcaattgaaaccgtattaggtggtgtgttacaacaggttgtagtagataatacatcaacggccaagcaggttatttcttatttaacaaaaaaccgggcgggacgtgttacaattttaccaatggataccatcaaatcacgtcacttaagcggtctggaagcagtgcaacacatggatggttttataggagttgccgcggatttgattgatatgcctgaggaaatgtctgctattaaagccaacatattagggacaaccgttttggcggaaaatttaaatcaagcaactgaaattgccaaacgtggacattttcgttttcgcgtggtaagtctaagtggccaagttgttaatgctggtggttctatgacaggtggcgcaacccaaaaacgtggcgcaaccttattgagtcgtcaatctgatattgctgaattaagtgaacgtacggatgaattaactgttcaagcaagaacattagaaaaaacactgcagttgaaacgttcaactggtgaacagttacaagaaaaattacttttgacgcaagaatcattgcgagcagctcaaaatgatactaaaaaaattgattatgagttatcgcggcaacaggatgctataaagcaacaaaaaagagccgtgcaagctattgaatatgaattgaaagaagtaagcgaacaacaactagaactgaaaaatcgcatagtagagtttagtactaaaatcgaaaatattgaacaacaaaaactggatcaagaacagctgactgccaaattagctcatgacttagagacagcttcaataaaatcacaatcaacaaatgaagaaaaagccacgttgcaaactcagtttgcaacagttggtgctcagcttgacagtattaatggccagttgagtttattacagaatcaacgtaatgaactacagagagagcatagtactgtagaagaaaacttaaaaaatctgcaaaaacaattggttatagcgcaaggtaatgtagctaatcaaagtataattgatgatatgtcgcatcaacttgatgccacacaagaaaagtatgacaatattaatacacaaatcgtggctttgacgaacagcatcacggatttggaagagcaatttgcaacgcaacaggagactttgagaacgcttattggatcacaaagtcagtctgcagcgcacttggctcgtttgcagacacagatagaaaatctgcaaacgcaattactgacgcagtacgatgttggcgatgtggaagctttgtaccaaaaagttgctgacatggatttccaaaatattaccgaacagttgcgcttagttaaacgtagtttagatgaaattggcaatgttaacattggagctattgaagagtatgagtctgtaaaaacacgatttgaatttttgacaaaacaacgcgatgatttgaactcagctaaagagacactgctacaaacaattgatgaaatggatacggaagtacaagttcgttttaaaaagacttttgatgcagttgcgacacatttttcagatatttatgccaaaatgtttggcggtggtcgtgcagaaattagcttaacagatccagcccatttattaacaaccggtattgatataacagcgcaacctcctggtaaaaagttccagcaaatgagtttgttgtctggtggtgaaaaagcattgactgcgattacgctgttatttgctattttgcacgttcgccctgttccttttgttgtgcttgatgaagccgaagctgcgttggatgaagcaaatgtggcgcgttttgctagatatttacgtgaatttgctggtgatacacaatttatcgttattacgcaccgtaaggggacgatggtgaatgctaatttgttatatggtgtgacgatgcaagaagctggcgtgtcaaaaatggtctcagttgatttagatcgaatggaagaagcagtttcataattgtataatttgtttaagaaacagctatatgctcagaagcgtgtattacttggattaggagaaaaataaatgggattatttgatattttccgtaaaaagaaaaatgaaacggttgagcaggagtctgcgtcagaatccactgaaattttgagtgaatctgaatctaatagtgatgcttctgaggatgagcaaagtactgctgtatctgaaaatacgtcagccgtgtcgcaaccgatgatggaacaagttggtttagttaacgaagatgaagccaagatttggcaagaggcgcttgacaaacaaaaaatcagtaccccacaattaacagaaacagaaacagaaacagaaacagaaacagaaacagaaacagaaacagaaacagaaacagaaacaactgagcaacaaatttacgatgcgggattgaaaaagtcacgtactggctttgcagatagatttaaccgatttttggctaatttccgttcggtggatgaaaatttcttcgaagacttggaagaaactttagttggtgcggacgttggctttgatatggctataaagattagtgacgaacttcgagaagaagtgaaattaaaaaatgcgaagcgtaaagaagacgttcgcgatgtcatcattaaaaaaatggttgatttgtatgaggctgacggtataaatgaagatgccacaatgaattttgcacccaaaggacaaacaacagttattctatttgtgggagtgaatggtgttggtaaaacaacaacgattggtaaattggcaagcaagtatcaaaaagcaggtaagtctgttttgttagccgcagcggacacatttcgtgctggtgctaccaaacaattgcaagaatggggtgaacgtgcgcatgtacccgttgttgctggtaaagaaaaagcggatcctgcttctgttgtctttgcagcagttgaaaaagctcgcgatgaaaattatgatgttttatttgttgacacggcaggtcgattgcaaaataatgttaatttaatgcaagaactagaaaaaatgaaacgcattattcagcgtgaaattcctgaagcaccgcacgaagttttgttggttcttgatgcaacaaccggtcagaatgcattgcaacaggcaaaattgttcaaaaattcatccgatgtcagtggtattgtgttgacaaaaatggatggtacagctaagggcggtattgtttttgccattcgtaatgaaatgcacttaccggttaaatggattggttttggtgaaaaagctagtgacctgcgtgaattcaagcctgaagaattcgtttatgggctattcaaggaattggttgaatcatgaatttagcaaagaagactcacattaacgaactatttggtttctatgaaaaattgttgacagataagcaacaagcttatttacgttactattttgaagatgattactctattgttgaaatcgctgaagcggagaccgttagtcgccaagcagtatcagataatatcaatcgagctattgaacaacttgaaaaatacgaaaacatccttcatttgcaagtcgattttgcaaagcgacagtcattagaaaaggatgttgaacaatatatcgagacacattatccagatgataatgtgttaaaattattggtacagaagcttttaacgacggaaattgataactagaagggaaatgtgcacaaatagtgtgtacagtttaataacctatggcatttgaaaatctaacagaacgcctatcaaaggcaattaaaaatctgacaggacgtggccgtgttagtgaagaggatttgcgcgcaacaatgcgggaaatccggttggccttattagaggccgatgttaattatgacacagtgaaaaaatttgtggccaatgttcgcgaaaaagcaagtggcactgatatcatggagggtttgaatccagcacaacaaattgttaagattgtcaacgatgaattgactgcaacaatgggtgaagaagcggtgccgttaaataagtcaccaaaaataccaacaattattatgatggctggtttgcaaggtgctggtaaaaccacaactgttgccaagctggcctacaaactcaaaaatgaaaataatgcccgaccattattaatcgctgcagatatttatcgtcctgctgcgattgatcaattagaaatacttggtcgtgacttagatattccagttttttcaatgggcacagacgtcaacccacgtgacattgttcgagctggattagagaaggctgctgagaataaaaatgattatgtattcatcgatacagctggacgtcttcaaattgatgaagaattgatgcaagaattaaaagatattgcagaaattgctgatcctgatgaaatattattgacagttgatgccatgactgggcagaacgcagcggaaacggccaaaggtttctctgcttcacttgatttaacgggtgttgttctaacaaagttagatggtgatacgcgtggcggtgcggcattgtccattcgagatgtcactggaaaaccaattaaatttgttggtcaaggtgaaaagcctactgatttagatgtgttctatcctgatcgtatggcttcgcgtattttgggcatgggcgatgtcttaacgttgattgaaaaagcacaacgtgattttgacgaagaagagcaaactaaacagctcgaaaaaatgcgtcaaaatacctttgactttaatgactttgttgcacaattaaaacaagtacagagcatggggccaatggaagatttgttaaagatgattccgggaatggcaaataatccagctttagctaatgttaatcttgatgctaaacaattcgctcatttagaagcaatagttggctcaatgacacctgaagaacgagagaatcctgatttaatcaacccttctcgtcgtcgtcgtttggcggctggtgctggtcggccaattgttgaggttaatcgtatgatcaagcaatttgatcaaatgcgtaaaatgatgaatcaagcaactaatgggaactttggtggcattgataaaatgatgagtggttcaggcatggatatgtcctcaatgatgggtggcatgaatggtggaatgcccaaaggaaacttaggacagaaaatgcaaaactttgctgtaaaacaagctgcacgtcggctgcaaaaggctaaaaagaaacgtggacgtaagtaatgaaaagtatggaacgtattttaccagtttttgtatttgtcgtgttacttggatcaaatttacttaatatttctcatttttcatttgtatcagttttctttgctgttttttggccactggtggcaggcgtttttgtcttcggactcataaaattattgtggtggtgggttcaacgataatatacttttattttcaatatatctaatgtttgttcgtattagaccgtttatgtataaaggaatcgataatgacacttaaacttatagcatcagatctagacgcaacttttttacgagatgataaaacaattaatgaaccactctttcgagaagtgttgcaaaaaatgaaagcacaaaacatgcagttcattgtagcgactggtaatcatttgcaaaaagttttagagtacttcaaaaactttgaaggtgagtatcaaatcatcgccaataatggtgctgaggtgatgttagatggtgaagtgcaaaatgtcaaatttttgcccaaggaagcattgaaaactattgtttctgtaactgaaaaatatctcgatgatgttgcggtgggattggcgtttaatggacaatcaactacatacatgttaaaatcacaggcagcaattggtgacaccttcaaaatttcctcagaatattttgaaaacttaacattagttgacagcattgatgatgtagtcgaaccgattttgaagtcaacaattgttttatctcataatgaagtagcttatatgaatgatctcaaatccattttaggtaaagttgttcatgtcactacttcggggtacggtgcgattgatattgttaatgctgatgtaaacaaagccaatgcactaaagtatattgcggatgcattgcatgttgatgcgaaagatattatggcatttggcgatggattgaatgacatggagatgttggaatatgttgggcatccggttgcgatgactaatagtgacccggaattatttaaacatgatttcgatatttctgtagccgataatcagcatgatggcgtcttaaaaacaatattagaaaacgtttaacacacttggcgtgtgtttttttgttatagtagaaaataaggtgattataatgataaaaaaagacggacatactcatacacagttttctcatcacggcagcacagagcagcttgatatgtatattgaacgagctattgatttgggatttactgaatatgttgttacagagcacgcaccgttgccacaacaatttttagaagaatttgttggtcctgatgatgcacgtgataattctgctatggcaattgatgagttaacattttataaatctgaagttgagcgagtgaaagaaaagtttaaagataaaataaacatcaaatctggttttgaagtagactatctaaaagcatatgaaactgacatacgttcatttttacagagagaatctaattggattgatgaaattgttttatctgtgcattttttacctaacaatgaggggaatgttgcacctattgattacgagccagatacattgtcagcatattttagtgacgagtgtcgtaatcctcaaatattatttaaacgttattatgacgcagttattcaaagtgtaaactttgatactgggctaaaagtgcctgtgcgaattggacatattacgctcattcgaaaataccaaaaactattgcatttgccaaattttgacgaatctgtcaagcaacggattactgaattgttagcaattattaagcaaaaaaattatcagttagattttaatgcggctggttttagtaagccatacaatggtgaaagttaccctacatttgatattgctgagcaagcaaaaaaaataggtattgagctggtttatggttccgatgcgcacgaagtgaacgctctaggattatattatgatgaaatgaaagaattgattgtagataaaaaataggggattagtagacataaagaagatgcagagaaaatttaaatatatgatggcaacattttttttagccgttattatcatcctgtttttaattatagggaaatatatgcaaaacaataattctgtttataaattgtatcgtacttggaaaacacaatatgttaagggtagtgctaacagttcgtttgttaatggtagtgacaaaagtggtgaaaaagtagccttgtcagaatctcaaggttacggcatgttaattacgatgttagccgctcaaaaaaatcaggcaacgcagtcagattttgataaatttgttgtatattataaaaatcacacgctgagtgagcagaaccacttaatggcctggaaacaaaatcagttgaataatgaaatgaaaactcttgcagaaaataatactaatgcgactgatggagacatggatattgcatacgcattgttaatggctgatcaaaagtggggctcaactggaaattttaattacaaaaaaatagccactaacatattaagtgatttgctcaaacataattataatgatgagaacgaattactaagagtaggaaattgggcgaaaaatgatgagaagtacaataatttaattaggacctcagatttaataccgagctattttaaaaaattttatgaagtaacaaatgataaacgatggcaaaaaatctaccttaaatctatcaaagtcttaaaaaatctaagtggtgaaaataagacaggtttaataccagactttgttttcatcactcacaataatatttctagcgtatcaccaaatacatttgaaagcgcgaatgatgacaagtatgcttggaatgctaatcgtgtaccactcaggcttgctttcaatacatctaataaagagttgaaaaacattaataaaaaaatgttaatttttttcaatcaacagaaaagtattaaagctgtttatggtttagatgggcattcagcaaataactatagttcaatggcgtttaccgcgccaattgccgttgcagcgtaccagcagaaatcagaatttaaaaacttttcgaataccttactggagcaagttgatagcaatgatctatcaaacagttattatgcagatacattaaaagttttggcagcgttaatgattaaaaatgatttgaaataattttcaggagaatttatgaatacacttatcttaggcattgaaggagcgttgctgtttctgaccgtcgtatgtttttgtttaggaaaaaaatatcatattttaaaacaggtattaattgttttgtatattgtcacaatggcggtttatttaatatggcgtataggttggaccatacctacgaataacgttttgagcattatacttggtattattttagtgcttgctgaattgggtggcttttgtctatcattagttttctacagaatgttttttaaaaaatttcagcgaccggttcaaaatcttgatgtttacgcagatggtcaatatcctacggtagatgttttcattgcaacttataatgaagaaacacccatactaaagcggagtatcgttgctgcactactaatgcactatccttctcctgaactggttaacatatatgtttgtgatgacggtagcagagaaaacgtcaagaagttatgcgaggaattaggtgtgcatcatgtggtcagggaaacacatgagcatgctaaggcaggcaatcttaatcatgctttaaaagtatctagcggtgaattggtggttactatggatgctgatatggttcctcgcactgactttttagaaaaaacagtaggttattttcataacaaaaacatgggctttatccaaacaccacagacttttttcaatgatgacccctatcaatttaatttgtttgctactaataccattggtaatgatcaagatttctttatgcgcagtattgaacagcaaaaagatgcatttaacgccacaatgtacgttggctccaatgcaatttttaggcgtaaagcattagacagtgttggtggttttgcaaccggagttattactgaagatatggcaacaggcatgttgttacaagctaaaaaatgggatacgggttttgtcaatgaaaacttagcgagcggtttagcgccagaaacttttggtgatctcatcaagcaacgtgatcgctgggctcgtggaaatattcaggttgcaaagaaatggcatccttggcgtgttaaaggtcttgatttgatgcagcgtgttatctatacagacggaatacactattggttttctggcatatataaactcgtgtttctccttgcacctatattatttttagtatttgggcaatatagtcttcaaacaagttttagtcaaattctaattttttggttacctgctttcattgcttctcagttgacttttaatttagttagtgaaaagaagcaaacagtgatgttgagtaacatttatgaaactgctacggctccttttatggcttacggtgtttttaatgaattgttcctgaagtctaagcagaagtttgctgtcacacgcaaaggggtgaatagtgaagatagcttttacaattggcgaacagcttggcctatcattgttttgttggtattatctcttttggggttagtcagagggatttgttttatatttggcatatgggcgagtccatttcctaaagaaggtatttatattaacattttctggttgatttataattcctttgccttgattttggcaagttatttgtcaaacgagcgaccacgactacgaaaatctgagcgttttcaaacagaaaaaagtattgttataaatttctataacttggggcaagtacaaggtcatattttagattggaacgaagatggtgcgcgaattgctctgatgtcccaaaataaaaataactatacacaaggtgaatttgtaattgatgggaaccaatttaaatttaattgcgtttggcaacaccaaagtatggaaaagctaattattggtgttacatttgatgatttaaatctatcggcgtatgaatatatcattgagcatacatatgcgcaatcctcgacactgtaccaaaatccgcaatattcaaatcaattgtggcatattgttgtgaagtggtgggttgacacactccgaaaacggaaggcgcattaataatgataaaacgaaaaaacaaaaacttgataaatagtggagagcaactatgactgagcatcacgagcaactgggagttattaaagatttttattttgtgatgcagccagttgttaaaatttctgataaacaaaaagataagattgcgttttacgaaatattattacgttcgaagaaaacaaggcaatttcctggagaaatatttttcgacttaatcaaaagtcaatcaggaaatcaaattgtgctttctttttttgaaaaacaattaaaggaaatattacaagaaaatccttgtactaaactttcaattaattttgaaataatacaatttaaatcaccacaaacacatgaattcttcgaaagaatgcatacttgggcacccaatattattgttgaactgacagaaagatcctatgcaactaatggcagcaattatttactggatgctgtcaaaaaaatcaaaaaaatgggctatagaatttttgttgatgatattggtacaggtcggaataccttgtcacacgtacaggacaatgtcaatttagttgatggtattaagtttgcttggccacattttaaagaggattcttgccaaattagtatttcatttttgaaagaatgggataatttagccaaaaaaaataatttggcctttgttttcgaaggtgttgaaaatgttgatactcaaatattactacaaaaaatgggtatcatttatcagcaaggttggttttttggtaaacctagagaggatatgatcgaggcacaaaaatgttaacctatttgtttagttatctattgttgatgttggttataatgaatttagctatttctacgttaatgagtatgcaatttttaatgtatagcaattccggtagccgttatgaacaatggataaaaccaataatatatattgctatgctttatacatcaatgtcagtttcttatcattttattggtgttgtagcacatgaatatttactcgcacttttaattttttacttggttgataaaaagcaagccattcttttggttattattacaccctttgtaagaatgctatacatgctatttgtggatggtcacttaacaactgttaatgttttggcttcactagtagtagctggaatggctatattttatatgaaagtatttgataaatatgtttctaatcaaacactctcaatgattctttctgaaatatttattgtggccactagtcttttttttgctcccttcattccccatgttgtgatatatagtatcttcaatcaaccaacgaattggataattcgtgccactgtagctattatcacgattttaataactcgaaaagtgtattttcaagttactaatttgcaaaataagaatattcaactgcagaaagaagttattttcgataaattaacaggtttttttaattataaaaaatttgaacaagatatcttgttaggtcctgacaaacagacaaatactggcattgcagttattgatctggattattttaaaaatgttaatgatacctacggacatgaagctggaaataaagttttacaggaattttctttatttttgagagagcgcctagcctacaaactaaattcaaaagatttaggaatttatcgctatggcggcgaggaattcgtttggatgtttgatcccaataatttttctgatatcggaaagttcttaaaaagcatgcaacttgagctgagtaaactgcctctaggagatcaaaatcacttgatgagtttctcggctggtgtaagtttttcaaaaaattataagtttaatttaaagatgacttttgatattgctgacgacctagtttatcagtctaagaatacaggaagaggcaagatagttattgaaggataaaatgatatgagaatgcatattttattatataaaaataagtattgacatatataataattgatgtaaaatgaaaataacttaataataaatttagctgaagttgaaaaagtagttaattaccgtgttgtacaggaagtgctcaagctaacgcattgagatgagcgccagcataattaatgaaaacacaccaacgagctgaatggttaaaaagccattccggaaattcccgataccgaataagcctgcgtgagtaggttattgagcttttttacgtaagtaaaattgaaatcaaggtgggaacacgtgaagacgtccttgcaaactaaaatattagtttgtgaggacgtctttttattatatggcatctaggagatgaacatgaacgataaagtattagcggccggttcgcgagacgaatttggtgaaaaattacaacaaaaacagaaaatttcacagatgataactacaatcttaaatgatgctgattttacaccgattaatacaccattaatcgagcgcgagagtacatttgataaatatcaaaacaagaatgtttttcgtttgtttgatcaggttggagaaaatttagttttacgtccagatctgaccttgccgattgcgcgttttttatcagccaatcgacaacaaaatagtatgtctagactttattatataggggatgtctttaggcgaaccgacagcttgtcgggtgattacaatcaagaaacgcaggccggcattgagctgattggtgatcaaagttttgaagcggaaattcaagcactagacacgatgcttaaatttgcgcaagagtttgggattgtggatgtacaagtggttttgagtgatgcccgttttattgatgtggttttagaaaatttgcaattagatcaagacttgcgacaacgtatgaagcaagctattgagcaaaaaaatgtatcggtctttgaggaacttcgggccactattcctgatttcccggaagggttggctggctggcccttagcatttggtgaagatggcgaaacagtgatgtggcaactgcaagaaataccggcagttaatgatattatcaatgattggctgaaattagcagaatatacgcacaaacattatccagcagttgcagttacggttgatttggcagcggcttcaccgcaaccatattatacgggcacaattatacgtggttttgttccaagtttaggtcgttatttatttagcggcggtcgttatgatcgtttgttagaaaacttccagaataaatcattaccggcggttggtatgggattaaatattgaaacaattttagctgactggcgacgtaagcctgaggaaatgaaaccacaagaacctattgtgatggtacttggcaagggacgtgttgaaaaagatgcacgaccattattgaaagcggctggtattgatacttcgttattagaaaatccagcacgtaaattaatatttgatagtgctgacggaaaatatcgctttattttggtaaaaccgagtgatgtcgttaaatatcttgatcgtggcattggtgatgtcggtattgttggctctgacacgatagctgagcaggtacaaaatcattacgatgtgcttaatttgcagacaggcaaagcagaattcgttgtcgctgcgccagaaggttttaatcttgatacgccaacgcgaaagcgaattgccacgaaatatcccaaaattgcgaccgagtactttagtaatcgtggggaagatgtcgaattaattaagttagaaggttctgttgaacttggaccactcactggtctatcggatgctatcattgatatcacacaaacaggaaacacactgcgcgaaaatcatctgcaggtttatgatgcggttggcccagtagctacccacatgctcgttcgtgctggcgccttactgcgttttcaattagagcttacgaaagtaatcaataaccttgttaatattttgaaagaagaagaacaatgaatattattaaaaatgaatcactggaagcaattaaagctcgtattcgtcagcaaacagagaagacggttgatccgcaagtagaggctcgtgtaactgatattattaaaaatgttcgcgcaaacggcgatgaagctttgaaagaatatggagaaaaatttgatggtgtcactttagataacttaaaggtgaccgatagtcagattgaagaagcctttaatcaggttaatccagccgtcattaaagcactagaaaaagctgcagataacattcgaagctttcacaaattagagattggtgaatcctttgaagataatcccagtaatggtgtgattcgtggaacaaaggtgacaccactatcagctgttggcatttacgtacccggaggtactgcagcttatccttcgtctgttttgatgaatgctattcctgctaaaattgctggtgttgaaaatattattatggttacaccaccgcaaaaaaatggtttaaaccaagctgtcttagctgccgctaaaatagcaggggtggatcgcatttatcaagttggaggggctcaagcaattgccgctttagcatatggaactgaatctattccacaggtagataaaattactggaccgggtaatgcctatgtagcgacggctaagcgtgacgtatatggtcaagtagatattgatatgatcgcaggaccatcagaaatcgggattttagctgatgattcagcaagtgcaaaggatgtagcagcagacttactctcacaagcagaacacgacgttaatgcacgcgcaattttgatcactaattctgaaaaattagcaacagcagtttcaaaggaggtcgaagaccaacttaaagtcttgcctcgtgaagctattgcgcgtcaagcaattgaaaacaatggtttcatatatttggttgatacgattgatttaatgattgatctgatgaacgctgtagcacctgaacacttggaaatacaattagaaaatgcgtatgattatatttctaaaattaaaaatgctgggtcagtgttcttagggcagtatgcttctgaaccacttggtgattatttagccggtccaaaccacattttgccaacaggtggtacagcacgatttagttcaccgctaggtgtttgggatttccaaaagcgcattcagtatttacaatattctgctgaagcattattggctgattcggctgacgtcacagtattagcacgtgaagaaggattagaagcgcacgcccgagcaattgaaagtcgagaaaaataatatgtccagaactgcaacaataaagagagatacttttgaaacacaaattgaattgactttagatcttgacgaacaaacaccgattaaagttgacaccggcattggttacatcgatcatatgttaactttgtttgctaaacatggccgctttggtttacaagttgatgtgaagggtgacttacaagttgatagtcatcatacgactgaagatattggtattgtgctaggagaagcatttacccaagctttgggtgataaagttggtattgaacgttacggtgcccaatttgtccctatggacgaaacactaacccgcgcagtgattgatttatcagggcgttcctacctagttttgcatgccgaacttactacaccaacattgggcacttttgagacagaggttgtcgaagatttttggcaaggttttgctgatcaagcaagagccaatgttcatattgaagtcctatatggtcgaaatacacatcataaaattgaaagtatgttcaaagctgttggtcgtgcaatgcgccaagcagttactatcaatccggaaattaaaggggttaattccaccaaggggcgaatttaaaatattagatgattttgtgaagttaaatcgtataatacaaaggagaaatatatggcgattattatcgtagactatggcgcgggtaatattagaaatgtcatgaaagcaattgaatatacaggattaaatgccaaagtttctcaagatcctgccgagattgctgccgctgatggtctggtagtgccaggagttggcgcttttgcctcagcaatggataaacttcgagaacgtaatttggttgaaccaataaaacagttttcaaatagcggtaaaccattgttgggtgtttgcttagggatgcagttactttttgactcatcaactgaatttggtgaaacgacaggtcttgggctaattcctgggcaagtggttgaattacctaaacaagagaattataaagtaccgcaaatgggctggaatcagaacaaagtgagccaaatcaaccaaatcactcgaacaatgaatgataaatatacttactttgtacatagctattatgcggtaacggattcaaaatatattgcggcaactgttaattatggaaaagttgatgtaccaagtgttgtggttaacaaaaatgtgattggtgcccaatttcatccagaaaaatctggacaagatggattagagatttggcaaaactttaaggaaatggtagaaaacgtatgatttttccagcaattgatttattaaatggtcaatcagttcgcctttatcaaggggattatgaaaaagaaaccacaattaacccagatccattgaaacaggcaaaacaaattgaaagcgcaggtttaaagcatttacacctggttgatttagatggtgcaaaggaaggaaaaccagttaatctaaatgttattcaatctttacgagaacaaacaaacttgtttattgaacttggtggcggtatccggactcttgaacaggttaaccaatacttaaatataggtattaatcgtgtgattattggatcagcagctttgactcatccggaacttgtgcgaacagcggttgcaaagtatggctccgataaaattgttgttggtgttgacggccgtgatgaaaaagttgccacacaaggttggcttgaaaattctgatacgagttttgatgatattgttgaagctatgttatcagtaggtgtttcgaattttgttgtcaccgatatcgccagagatgggaccctatcaggtcctaacattgagctattatcacgtttacaaaataaatttcctaaaagcaatattatagctagtgggggtattgccaatattaaaaacgttacagatttacaagcaagcggtattcacgatattattgttggccgagcactttatgatggagatgtgacactagctcaattaaaggaggtggatggatgactttagccaaacgaattgttccagcattagacattaagaatggtagagtagttaaaggggttaattttgtcaatttacgtgaagtaggtgatcccgttgaatcagcgaaagcctatcaggctgctggcgctgatgagctagtgtttttagacattacagcaactttggaagagcgggataccatcatgtcagtcgttgatgctgtttccagggaagtattcatccccttgaccgttggcggtggtattcgaacgacagaagacatgggtcgtttaattaaagcgggagctgataaaatatttgttaactctgaagcagtaaagaacccagcgctaattacggacggggctaaaatatttggctcgcaagctatcgtcggcgcaattgatgctaaatgggatgaatcggctggtatttatcgggtctacgtttctggcggatctaagcctacaagtcttgatgctattgaatgggcctctgaattagtcgctcgtggggctggcgaattgctagtaacaagtatggatgccgatggaacaaaaaaagggtacgatattcaactctatgatcaactagcagatgctgtgaatgtaccagtagtagcctcgggtggtgctggttcaacacaagattttgttaatttatttgagaaaactaaaattgacgcagcactagctgcttcagtatttcattttggtgaaattaaaataccaaatttgaaacgaacactgaaagatgatggtgtggagatacgcatatgattggaactgaaccggatttcaacaagcaaagtcaaaatggtttgatccctgctgtcattgtcgacgcggaaacaaaggcatttttgatgctaggctatatgaacaaagaaagttattcattaaccaaaagtactgggcaaacttggttttggtctcgtgagcgacaagaattgtggcataaaggggagacttcgggtaacatacaacaggtcgttagcatgacattagattgtgatttagatactctgctaattcatgtgaatcctgcagggccagcctgtcatactaatgcttactcatgtttttttaacacgataaaaggtgaaggtttagcagatgctaatcaagcaaccattgcaaataaatggactgatggttattttccaaaagagtaaataccacactaaaaggagaaatgatgccacaacaaacaattgaagaactttatgaacaagcacttgagcgcaaacaaaatccccaaacaggatcctatactgattatctatatcaaaaaggattagataaaattctaaaaaaagtgggagaagaaagcacggaagtaattctcggcgccaaaaataataatgaagagctaatttatgaaacttcagatttattgtttcatttaatggtcttattagttgaaaagggtgtcagtttagatgatattaaagatgaattagggtcacgcttaggaaaaaaatcattattgcatgaacgcgctgattggcgaggagataagaaaaatgaaaaagacagttaaagctttagcagcttatcaagcagaattaccagtagaaactgtaaaagcaaagtatggattgcaacatttagcccgcttatcagccaatgaatctgtgtatggtccatcacccaaagttgctcaagctgtacgtgctgtttccgatgatattttaggttattatccagatggacaagcgacagaactacgtgaagcggtagctaagttaaatcatgttgacccacaacatttggtgtttggtgctggcgcagatgaattgattgagctgttgactcgtgttgtgttggaaccaggatcaaatattattattcccaatccgacatttggtgaatatgcgatgcatgcacaaatcgaacagtctacaacaaaaaaaatacccgttaatgttgataacgggcatgttgattttgatgcgattttagatgctattgatgataaaactgctatggtatggatagctaaccccaacaatccaacaggggtattcgaaacaaccagctccattaagcgctttttggacaagctgccagcaaatattacgttagtagtggacgaagcctactatgattttgtagatgaacctgatgctaccgtggcacctttggtagctgagtacacaaacttggttgtgctacgtaccttatcaaaggcatacggtctagctaatttacgtgttggatatggcattatgcaagatcccctttatagtgcgatgcaagcagttcgtttaccgtataatttatcaacctatcagattgttggtggcacggctgctgtattagatcaagagtacttgcagaaaaatgtccaacgttttcaagtagagcgccaaaagttccaagattttttgactaaaaataagtttaagttttatgaatcacaggctaattttatttggataaaggttggcgaaacgaaaaaagttggtcaaaaattattagaacaaggtttccaagtcaacgatcgacttaatcctgagtggattcgtattgcgttaggtacaccagaagacaatgctgaattaaaattagcttttttgaaagctacaaacaaataaattcacggatacacaaaaatgttgcgtcattaaataacgacgcaacatttttgtgttattaaatttcacttctttacatcaatagccttacaaagtgtttgcctgatttaatacatctttgaagcgccagtcttcttggtggtaggcttgttcccagaactgccattctaattcacaacttttaagaaaaaactgtgtggcctgttggcgttgttgagttgttgcattttctgccaagcgatctatccattcaaagattttgtcagatagtgaaacttccgaatcatcatctgtattatcataaaaatcaatccagcttttgaatgggttatcatttgtgttcgctttctcctgaacttgtttttttgcaatttcattataggtccaagggcacgcctgaaaagcagctagaatatttaataaggagccggtgtcagccgcacgatacatatgtgattcgtatagatatgctttaggtgttggcgtggcgtgttgcaatgtttcatattcgacgccggcaacgtcacaaaaaacatgatggggatgaatttcgctatttaaaatgaaatcaattgaatcagcaaaaaatttcatttcattacgatcagttaattttgtaatggcattggcataaattttgataaattcactaagatattggaaatcttgttcaacgtaaaaaatcaaagcttctcggggaacgtaaccgtccgcaatgccacgaacaaatgcgtgatcatgaatggctgtcataattggtgcagcttgggtgcgcaattcttctgaaaacataatttctcctaaaatctttacatgtccaacaaaaaaactctctcttgactataggcaaaaaagagtatcttttgtaaaaagaataccactttcctacgctagtattgactagatcaggttcgaagggattgataagtaatatcatctcagccaagaaggcacccctagtggacagcatatattttttttaatgagattagcatagcattgaaaaattaaaattgcaaatggttttatggtgtagctaatgggctagaaaatttctttgcatttaaaattagaatgggttatactaattcacgaagttaatattttatctggggtaccgtaaggttgagataatacccattgaacctgtcaggttaatacctgcgaaggaagaataagttagattaagatgtctttttgatgccatcaatcactaaattcttttgtggttggtggctttttgtatagacacttatactataaaaggtattttatcgaaacatacagcctcgaaacaagaggagagatgtttatggaacaagtagaaacagtaacagcgggatcaaaagggaaatggtctttgcgagaagtcattttaatggcgttgattggtatcgcctttggtgtgatttattttattatggatccagtgtacacagcacttgatgcagtcttagttccgcttgggttacaccaatacaccattgcaatcactattgggccatggatgatggcagccccattggctagttatttattgaaacgtgttggtgcgggattaataggtgaattgcttggcgccactggagaagccttgttgggcggctattggggtgttgcaacactaatttctggatttattcaaggtatcggatcagagcttggttttactttgacaggatataaaagctggaaaatgggtttgattttgtcaacatttactggaacatgcgtgacattcatctggtcattgttccacgatggatatctacaatttgattttggtatgctagttgggttgtttattgttcgctggatttcaattgcattttttgctggtctattagtttactggattgtcaacttgctagagaagtctaaattattaaaaacaaaccgataaggtcaataaaagtatgacggaattaaaggccaatcatttagatattaaatttgacgatgaaattatcttagaagatatttcactggagattagaccagaacaatttatattattagttggttcatctggatgtggcaaatcaactttgatgactgccttagctgggttatatcctaaatatggcggcgaattgtcacaggaagtgtctttgaaccatcagtcaattgctcaaatcaaagcgaaccatcgcgctaaaaaagttgccatgctatttcagcatccagatcaacaatttgccatggatcgcgtagaagatgaattgattttttcattagaaaatttatctttaactaccgaggaaattgataagagaattaattctgctttatcagaggtaggaattgaatcactgcgacaccgagaactttcatacttgtcaggtggagaattgcaaaaggttgctttagctgaaacattagcgatgggtgcagaaattattttattggatgaaccttttgcggccgttgatccagagcatcgacatgagttacaagtattgttaaaaaaattagttgatcaaggacatggtattttagtttcagatcatgacacaagtggatacgaaaatctgataacagatttatatcgtattgaaaatcgacatatagcatgtgttgattctacagcttggtctcctttttttaaacaagatgtaaatgatagtattgttactaatgatgaatttaatgagtctgtgtttagcatggcacatgtgacggtaaacaacggtaaacaatccatattgaagaatagcagttttgagtgggcaaaagataaaatcacattaattactggacccaatggtattggaaaatcaagcttactgcttacttttgcaagattacacgattatgagggttcgttgttgtatcaaaggaagctactcgataaacttcgtaaaaaaatatatgctaggaaagttggtttagtttttcaaaatgcagctgaccaatttttaaacattaccgtttctgaagaagttgagcaggctagagcccatagccatcacgctgattattggacaactgagaaggttgaccagtgcatgcaaaagttaaatttaataggtcttgaaaagcatagtgtttacgaattgtcaggtggccaacaaaaaaagctacaaatactgattatgttaattattgcacccgataccttgctgttagatgagccattatctggattggatacgaattctattcaacatgtcatgcaaatcattaaacagtcgtcaaatgaccttgaacaaagtattatcatgatttcacaccaaacacacggcattattcaatatattgattatcatgttcgctttgatcaaaatggtttgaaatatgaaagtgtagttaattcatgaatgaaacacaaaaattactattagtattgcttatttcgatagaaattgcgttcacaaaatcagtttatctcaatctgtttttaattgttgttagtattttgattttaatagtgactaaaagccatttgaaaacttttgctcgattattgattgtatcaattttgccggcagtcggatcattcacctcattttatttttttggtacaggagacgaatcacaacgattacattttgcactagtaatgaccacacgtgtaggtgcttatgtattcatgggtgcggcatttatgtcgactatggttttgtacgaattattacgttctcttgaacaaaatgtcaaaatgtccgcaacctttgtatatggcattctgggtgcattgagttttattcccaaaattataaattcagttaaaacgattcgggcagtggggctgatgcgaggtgaggtcttgagtttttggtcgcctaaactttattttaaagccattagtcaagcattaatatggtcaaataatttagcgatggctatgacctctcatggctttgaagaaggtgaaagccgtagctaccaccgattatttccaacaaaagtttctgggtggttaatcattggcgtcgttatgctactcattcagtactgtttatttgttattaagctttggtaaacaaatgtgttagactatgattatgaaattaaaacaagcagatttactttttgtaaaaaatggacatagcgatctggatgagggtattgcagaatcaacgggaaattttgttcatgttgcgatattagccgacgaagaaaatgtcattcatgcaacagctgcttcaggcgtttgtttacaatcgcttcagctttttttagagaaaaataaaagtgctgatgtttaccgcacaaatgttaaaaatacgaagcgaattatttttaacgctaaaacgcatttgggtaaaccctataacttttcttttcagccaggtacgaacagcttctattgttcacagtttgtagtgacagcctttgaagactttgtcaaatttagtgaacaaccaatgttttttggagacaggcgaaaacaaatttctgacttttgggctgcttactataaggaactaaacgagccggtgccagttaatgttttgggaacaaatcctaatgacatgtctcacgatccgcagttacattatgttggaaaaattgacttataatttaaattagtaaatactaaaaagccacaatatataatgatattgtggcttttttaagtgtttataggggaacatatcaatcaaattttagagttaatagaaccaagtgtcataaatagtgattggttcgtgacgcttttgttgcgttgtcagatacatctcttctattcgttcggcatcggtgtttgcaacatctttgccttccaaataatcgtcaatgacatcgtatctaacacccagcgcaacttcatcaggcaactgtgggcgttcatcctcaagatctgcagtaggtactttgtcgtatagatgctttggggcgtgtaatgcttcgagaagctgccttccttgtcgtttatttagacgccacaaagggttaatgtctgtgccgccgtcaccatacttggtgaagaaaccagctacagcttcagctgcatgatcagttccgataacggcactattatgctcgcgagcaacagcatactgggcaatcatacgtacttttggtttaattgaaccgcgactcatgtcatcaacggttaatccaccaagacgcagtgaacctaccagagcatcggttgcatctttgatatttgttgttactgttaaatcaggtttgataaaattgagtgcatcttgggcatcgttttcatcttgttgttcaccgtatggctgcctaatcgcaacaaattcgaacttttgattcgtttctgctcgtagttcagcaatagcaagttggccaattttaccagcaagtgtggagtcttgaccaccacttactgcaatagctaaaccggtgtaagcactgtgagtgagatattgtttcagaaaattcacagagcgcttgatttcaatgtttgggtcaataacgggctgaacgtgcagatcagcaattattttagattgtaaaggtctcatttggtcatctcctgtatattgtttcgaatgtcatgaattaaattcattttagcatcatatagcttttgagataagtcaacaggataggtttcaggattcagtatacgtttgtattcatcccatagatcgtttaacgaatgtttggcgtagcttttaattgtagtaatatcaggcaaatcataaattaggtcaccctcaacaaaaatatcatgtagcatcggttgtgcatcgaaatttttaatgttcttagaaataacaggatgattgggatcaaacatgtgcaaagtttccaattggctaggattttcatcatcgaaagtcaaataatcaccttcagatttgccatctttactatctgttattcgccaaacttgcttttttccaggggttgagattttttcaacgttgtttgacaatttaattgtgtcatcgccgtcgatactaaccatcttgtataccgcacctaaggcaggttgatcatatgctgtgattaattttgtgccaattccccagacatcaatttttgcaccctgaattttaagatttaaaatggtgttttcgtctaaatcatttgatgcataaattttggcattcgtgaatcctgcttcatctaacatgatacgaacttttttagaaaggtatgccatgtcacctgaatcaattcgaaccccttgaaaattaatcttatctccaaactcacgggctactttgatagcgtttggaacaccagattttagtgtgtcaaatgtatctactagaaaaacaacatttttatgtgttgctgcgtaggcatgaaaagcatcataatcgttgtggtaagcttgaacaagcgcatgagcatgtgtgccagaaataggaatattgaatagttttcctgcacgaacattagatgtagcatcaaagccaccaataaaagcagcacgggtaccccaaagcgcagcgtccaattcctgagcacgccgtgtaccaaactctaatagggggtcaccatttgttacactagcaatacgagctgctttagtagcaatcaatgtctgaaagttgataatattgagcagtaaggtttccaataattgagcatcgaccagaggtccttcaacttgcaaaagcggttcattgttgaacatcacttcaccctcataagccgaacgtattgttgcagtcaaatgccagtttttaaggtacgttaaaaattcagtgtcgtataggtctaatgattgtaaataatcaatatcgtcatcagtaaatttcagttgatttaatattttgacaattcgttctaaaccactgaaaataacatagccattattgaaaggcattttacggaaataagcctcaaaaacaacgggtttttgatcaataccttgtttccagtaagtataaatcatattaatttggtacgcatccgtatggagcaccagtgagtcatcagaatacatgttcaagtcctttccttccattataacaatattttttagttgttacttaaattaataagtattaattatatgtcaatttgattgtagttagatactcaaatatttaattcttgtaataattttacgagatgattaaattttataatggcttaattcttctagggctattaaacagtggatttttgaattaaattcgaaaataggacattttttgtcctattcttattgaaaaaatagttgtagtatttaagttatagcaatttaaaaaatagcactggaggaaatagtttagtaatgaacaatacgattaaacttatgaagttacctgatttaacagtaatcaagcatagtggtgaggggacacaattctatgcctataaaattaattttattttagaaaaactcaatttatcagaaaatattatcaacgatatcaatcgtgatttatatcaaatgttggcgaaccaagcgagtatcacagcaatagaaattcgtaatttattggtttccttacttaaaaaatatgaacagctggatgctgtggatgcttacaattcatactacgtagctgatcaacaaaaattttccgatgcttcaaatgttcaaaaacgcatagagaaactttttgcacaagatgagagtgtcgttcatgaaaatgccaataaggatagtcgcgtattcaatacgcaacgtgatttggaagcgggagcagcaagtcgtgcattaggattacaaatgctgccacctttggtagccaaagcacatttacgtggagatattcattggcacgatttggattattcaccagtcacaccagctaccaattgttgtttgattgattttgaaaacttgctaacaaacggctataaaattggaaatgcgtgggtagattcaccacattctattcaaactgccactgcgcagatggcccaaatcattgctaatgttgcatcttcacaatatggtggttgttcagctaatcggattgatcagttacttgcgccttacgcacaaatgaactatgacaagcaccttgttgacgccaaaaaatggattgatgctgaccgacaagaagagtatgccaaagagaagacttgcaaggacatttacgatgcgatgcaaggactggagtatgaaatcaatacgttgtactcgtcgcaagggcaaacaccatttacaactgttaattttggattgggaacaagctggttagaacgggaaatccagaaagctattttacagattcgtatcaagggactagggaaagagcggcgcacggccattttcccaaaattaatttttactttgaaaaaagggctgaattttagtcaagaagatccaaactatgatattaagcaattagctttggaatgttcaaccaaacgtatgtatcctgatttattaatgtacgacaaaattgttgaattgacaggtagtttcaaaacaccgatgggttgtcgttcattcttacaaggctgggaagatgaaacaggcgttgaagttaattctggacgtatgaatttgggtgttgtttcagttaacttgccacgtatttccctgtttgctaagggtgatattaatctgttctggaagatttttgatgagaaaatggcgctatgtcatgatgcgctagcttaccggattgaacgtaccaaagaagctgtaccagaaaatgcaccattactgtatatgtatggtgcttttggcaaaagattgaaggccaccgatagtgttgatgaagtgtttaaaaacggtcgcgctacgatttcattaggatatgtgggcgtttatgaaacatgcattgcattctttggtccagattgggaaaagaatcctgaagcacatcaatttgctgaagcagttgttaaaagaatgcatgattattgtcaagaatgggcagcagagagtggttatcactatagtttgtattcgacaccagccgaatctttgaccgatacattttgccatcttgaccaagaaaaatttggggctgttcctgatattactgataagcagtactataccaatagtttccactacgatgttagaaagcatccaacaccatttgaaaaaatagcatttgaagagacgttcccaaaatatgcgtcgggtggttttatccactattgtgaatatcctaacttaaaacaaaatcctcaagcattagaagctgtatggaattgggcctacgatcacgttggctatttaggaaccaacacgtgcatcgacaagtgtttcaagtgtggctttgcgggtgaattcaaatcaacagcgcgtggctttatgtgtcctgagtgtggtaaccatgatcctgaattgtgtgatgtggtcaaaagaacgtgtggctatctaggaaatcctcagcaacgaccaatggttcatggccgacatgttgaaataatttcacgtcaaaagaatttaactaaggagatgattgaaaatgtcgcgacctttgcgaaaaccaaacaatccgatgcccaaagaatggaccgcgcaaaagtatagtcaaaattatgtagctgactataaagccttcaattttgttgatggcgagggggttcgttgcagtctatatgtgagtggttgtctgtttttatgtcccggctgctacaatgttgccgcgcaaaactttcattttggacagccctatacacaagaactagaagaccaaattattgaagatttgagtcaggactatgtccaagggctgacgctgttaggtggggaaccattcttaaatacagatgtatgtctacagctctgccgtcggattcggaaagaatttggccattcgaaagatatttggtcgtggactggttatacatgggaagagctggaacaagagacctatgataagatgcggttattatccttactagatattctggtggatggtcgcttcttggaagaagaaaaggatttaacattacagtttagaggtagcgctaatcaaagaattattgatgtacctaaatcgttggcacaaaatgaagttgtcatttgggataagttagtacgatgatttattaatagtaatttttggaaaatgtgtacactcgtttttataaaacgagtgtacacatttttttattgattaatatttacaaatgaagttcttcatcaaaaaaatgttggcgaaaatgattaggagttattccggttatctctttgaaagttttgacaaaatagcttgcggttgaaaaagatagtaaatttgaaatctccagtaatgtgagattcgaagcaatcaacaattcttttgccgtatctattttggtttgcctaatgaattgagtgatcgttattttatactcttttttgaacgctggattcaatgtctttttcgaagcattcagtgcggtagcaatgtcatcgagtgtaatgttttcgctaatatgctcttttatatattgtttaattctttggtggagtggtaaaaaaatgtgaaccctatggttttgtacaattttaaaataatgccaagtaatttctctaataacttgaaaaaaattcaggaactgaggagatagttcaatttcttgaacaagctcattatgcaattgaaatgctgactcgacagggtacccccactggataatcgctcggtttaaaattgagacataggaaataagcgtatctttttcgcctctaatcatgttgttggaggcaaaacgttcaccaattatttttaaacgtgacaacttttcaagtgctgagattaaactggctttacgtgaataaacaattgatttgataatatcagtttctgcattaaaaaaagtttttggatcaaaggattcgctgctttcttttttgatgtggagtttatctgaaaactttgtaatgtggacttcttcttctggcgcatcgttagaattatataaagtatagatgatttgagaaatggattttagatttgaaagggaatgtaacatcattaactcactactcgttgatagtggatcgtcgtatttaaaagagaagcaaacgatgctttcttcattgacatggcaagttaaaatatgaccagaattatagtctagagattgataaatgtgatttgtgagcagctcaatattatcaattaataaattcacaacatttttattggaattatcagtagattcatctaagtaatttacttgttttgtggcaatgtcaatcaaaataacatcagcatttaaaatgtttgctaactttttaatatctttcattacttctcccggaaattacatttaatcactaaacgtgttattaacatttgttctctctttataaaatatgtttattcataattgtataaaaactattgagtaataaatataacatcaggaagcaaaatatctttttttgatataaactacctttttttatcatgaaattgcaaaaggattcatacataatatgaagtacttgtgatcatatagcttaatttcgagagaataatcacatgtaatttgtagagaaaggtggataaaaatagagaagtacatcacatagttacagattctgtaattggtgaaagtcataatatattttagcctgtactaaacttttatcaaaaagagtttgtatttttaaaattgcggttctcaatacaaactagcaattttaacactttgtgagagaagtgatgatttttaaaacaagaacgctgaagagttcttagaagggagaaatatgaaaaataacattcacaagattgtgaacggcttatttctgcgtgtctttggaattttgttgatattgtcaacattagtagcaaatgcgctgatgattccactaactacagtatctgctgcgagtgatattacgccacagtatacgagtaatagtacaggcgtatttcccactaattcgtggactattccaggtcaaaatacggtaataaatcatcaaggtggagatgctagtaatggctgggacaagaatagcagttggaatggggattcatctgatacatcaaaatcatatttgaaatttggtactgacactagtaacccagattaccaaattcgtaagtatgctaaagaaacgtccacacctgggttatacgatgtctacttgaatgctaaaggcaataaattaaaagtttacaagccgattgacattgtgttagtggttgatatgtctggatcaatgaatccagaaagtaatggtggtacagatagaataacagcggttaaaaatggtattagcgattttttcaaacaaataaagaattctgggtttgctcaatatgttaatgttggcttagttggattttccagtcctgataaatttggtatgaatgcacaaggttatgttactgggccaattagccgaagtgataatcaggataatataaatgatattttaaataataagctgaacaaagctaattttaagggtggtacgttcacacaattagggttacatcaagctcagaatatgctttccggtcaaagcagtgacaataagaaaatgttaatcttgatgactgacggagttccttcttattcaaacaaagttttatctgctgtttcttctaatggtatgactcttggtacgtcatttgattacaaaaattataacgccccaggggttacttcagcatttaataataataagtatagatgggatagttacacacaaaaatacatatctgatggcgtaaatttttattataacgtagatggactgccaattaaagatacatggtcaggaacattaggagaagcagctatctcaaaaaaaataggtacagaaattcatgctttaggaattcagctagctgatgattattatcaaggaaataatgtttatcttagtaagagtgagattcgagcacggatgaatcttcttgtttccccgtctcactatcaagacgcaaatgatgcagtaggggtacaaaaatatctttatgatcaggcacaaacagtcctaagtcaattcaacacggtcaaccaaggcagtatttcagatccgttaggttctcaatttatttacggagatgacacgccgacggttaagagtgtaggaagtagtgttgttcagaatttaccaacagttaccaaatcaaacggaagtatctctgtaagtaatattaatctggggaaagatcaagaaattcaaatacattatcaggtgcatttaaatactgaatcagataattttaaaccggattactggtatcagatgaatggcaaaacaacatttacaccgacaaaggatagtaacgctgtagaatttggtgttccttctgcgaaagcacctggaacggtgctaaaggttatcaaacaatggcaagagttgacagattcatcgaagcgaccagatagtattaattttgaagtaacgcgaactacgaacaaccaatcaaacgattggcgggcgactggtactttgagtaaatcggataattggtctaaaactttcaaacagttgaatagaaataatcaatcggtttcgttaccagcttatgataacaaaggtggaacgttcaattatcaggtgctaaacgaaagtacggatggttacgtttcaagcattactaacaaaacaaatgagtcaacgataacaaatacacaatatggtttgattattgataagtatgcaagtaactcgaaaaataaactcactggtgctgaatttattgttaaatcaacggatggaaagcagtcctatacattaaaagataatcagctacagcaactgacaccaggggattacaccattcaagaaactaagagtccatctgggtatcaacttgattctacggtttatccaataacactatcgcaagatggaaaatggtcaagtagcggtcaaggtattaatgtgaaatcaccaaccacggatggcaacggctataaagatggtttttctattgctactgacaaatcaaacaatactgataagaataatgttgttagatttgtcaaaaatgatactttcaagaagtttaatctgacagttaataaagttgacaaaacaactggaaatgcgctaaaaggtgctaaattcacattaactgactctgatggcaaaacatcagtttacaaagaaaccgatccaacgtcgactttcacttttgaaaatctttcatcaggaacatatactttgaaagaatcaaaagctcctgatggatacattgctagtaaagatgtcacaataataatttctgatgatggcagtgttaaggtaactaacaataatggcgattggaaatcaactttacaaaatgatgcaggtaacaatcagattagcctaacggtcaacaattcaaataaaactgtttttccatctacaggtggcactggtattgtgcgctacatgttgatagctggtgcctttatattaattgccttgggtgctagcggttattatattttccgaataaagagggggaaccgatcatgattaaaaaaatgattgtgtttatcattacctgtatttcatttgggttgcttagcttgcaacaagacaatttaaaggttttagccgatactgataaccaatttacgatagaattgcatcatcagttgagtgtgtatgaatcaaatccagtatcctatactcctggcagtaacgtaacatttcaattgtatgatttgacggctgattaccagaagcatgaaaatgatgaaaattattttgaagatttgaaatctcaaaatcagggtattcaaaattatattcaagacaatcatattcgtttgatggatactaaaactactgatgccaatggacaagcaacatttcatgtttcaaaagaatatggaaaagcttatcttattgtgcaacaaaaaagtagccaacttgaaagtgatggtttatcctatgagcaggttagtgatccagtcgcattttcgctaagaaatcaagatatggataaaaacaagcttgaaattgagaccaaatctgctattgtgacacgcataccatatttttttaaatatggaaaaacgcttgatcataaagaattaccattagcaggtgtcaaatttgtgttgtataaaacagttgacaaccaaaaaaaatacctgactgatgacaatagttggaaaaccactgatgacccattacatgaaaaagaagtaaaaaaagtcgtatctgatgataccggtttagttgctttgaataatagtaagctacccacgggtcaatattattttcaagaggttcaaacattaaagaactttgaaatatcttctcaggcaaaacacattagtgttaatatcccagcagtcactagcttagctaatgtaccgccaattactgttaatggcgagccgttgtctaaaatagctgcgggtgtgatacctaatgacgtgtatcaaaatgcaagtccgagagttttgaattaccaaaaaaagcaacccactaagaaaccaccgtttagcttgccattcttaccagaaacaggaatagcaattggttcaatttctttagtcggtttgttgattattttattggtaatattgataaaaatttataagaagaaattacaattaaaaaggagttttaaaaatgaaaagtaaatcatggtcacaaatggctaatgcgattttactcgtacttcctcttttagtatcagccttgtttggtattactaatgtatctgcggacacaacagatagtgttaatgttacattgcataaaagggtctttgatgaaggacaagtaccggatagtaagaccaatacaggtgaagtagataataattttggtggaacgccattagcaggtgttacttttacagcttatgatgtaactgaccattatttgaacttacgttctagtggtgacactgctgaaaaagcatcccaagaggttcaatctgatgccgctgatgctgcaccaagttacgccacaaaagttgcagaaggtgtaacagctggagccgatggcacagtaactttttcaaatttgaagtctaaggacggcgataaagacaaggtttacttgtttgttgaaacaaattcaccaacaaatattacacaaaaagctgctccaattgtgttagctttacctgtttataagtcagggtcagactcagaaattaattctgatgttcacgtttatcccaagaacgaacaaactgatgctattacaaaagatttaagtgacgaaagtaaaaaagatttgattgtgacattgcctgatggatcaaaggtttataatgccacttatggtcaaaaatttggttatcaattgcaaatagcagtaccatggaacattgcggataaagatacatttaatgtagttgatacgcccaacttaggtattgatgatgatgctactacggtaaaggttgcaggattaactgaaggaactgactatacagtttcagcaactgatgcaactgacaaaaatggtaaaggttttaaaataacatttaatccaactgcagctgctgttaaggctgctgccggtaaaaagttaacagttacttatgatgctaccttgactaatgctgctgttcctgacaaagcattaaacaacactgcgactgttaaaattggtaatgatccagaatcatcagtaacaggacctgaaatttacactggtggtgtgaaatttgttaagcaagacaagcaaagtgctgcaaagcttgctggtgcagagttccagttggttaagttaaatgctaatggtgacaaagttgcctacgcaacgcaagcaactgatggttcatacacatgggcatcaaataatgactcagcgacaacatatacatcaaatgatcaaggatcagttgaattaaagggtcttgaatattcaaacaagttggctgatggtcaaagctatgcacttgttgaaacaaagtctccagctggttatgcgcttttgacagctcctgttaagtttacagttactaaaggaagctatgctgacaatcaaacaatcactgtgacaaacattaagaagggtatcttaccatcaactggtggttctggtatctacttgttcttgattgcaggtgcacttttgatgagtggcgcatatgtttggaataagcgtaataaaaagaaccaaaatatttaatcatatttgaaaactaaagtgcaaaccatgttcgtggtaagcactttttttataaaaatgaatactatgttcataattctttggaataatggttttcattgatattatgagccgtggtttcaaaggataactagaacgatggcagaacaaaaacaaaacaacgctaatatttttctgaaactgttcattgcattaatgtttttcattggttttttggtgttcatgtatccttttattgctaatggcgtgaataattatgtggcccaaaaagaattaaatgctgtgaatcaactaaatcaaagcaatcagaaagccagtgccaagaaactcgaaaaattaatcaaaaaaaacaaacaaaagtcaaaagaaaatcaacaacttggtatatcacctgtcaagaatatcttggggcaaacgctggaaaatgtacccaaggagagtagagagtactatcaaaagcactcgttaggaagtatattcattcctaaaatatctctgagtttaccggtgtttgatacaacgactgacagccttttgtataaaggaattacattattacctggcagttcttatcctgttggtggcaaaagtacgcataccgttttgatggggcacagtggtttgcctaatcaagaattatttactcatctgcacgaattaaaaaaaggcgataagttttttttgaaagtgtatgggaaacgtttagtttatcaagttattcgaatcaaagtagttttaccaacagatctaagtgatatcacaatacaaaataaccaagatttggcaacgttggtcacatgtacaccctatatggtaaacacacatcgattgttagttactgggaaaagggtgccgttggataaaggttcatttgataaacaagaaaaaaaggcagtatcatatcaaggaaaatatttgttttgtctgacagcactgattcttatttttatggctttaattttttatatcatcaaacgtgagcttattgaactattgtcacataaaagaaattatcagttatcattttttgtttataataatggacgtctcatttctggttataaattcactgtagtagattattttggtaaaagaatattaaatgaccaaggtgagttatgtgagtctacgagtgactcaagaggctatgtatcgtttggtgaaattaatggtggcaggtataaaatagttccgatgaatccaaacatgaacctcaaaccttttaaagcgatagttaaacatttaaaggataaaaaattctatataaaaaaagtagttaaaaatggttaccaaattcaaacagaaggtgatgcaacaaatgactaagcaaaccagtaaaaaaaagaataaacaaaatatatttttaaatattatttttcttataggatttttagtagcgttgtatcctttttatgtcggtgcattgaatcattttattgaccagcaacgaatcaagacaattcaaaaggaaactaatcaagatatatcagcaaaagaaacacgtatgcaacagaaaaatgcacagttaagaaaagatggcattcaacctgggagtgacccattttctggttccacttacaaagagcatgtggtattgaagaagcatttaattggtacaattagtatttctaaaattaatgtgcatattccgctttttgatacgacaaatgaagaaacacttaactatggcgcaaccgtcttacaaggaacatcttttcctctgggtgggaaaggcacgcatagtgttatttcggcgcaccgtggcttagcttcacgaatgttatttacgaacttaaatcatgttaagaaaaacgatacttttgtattaacggtatttcataaaaaattagcctataaagtttttaaaattgaagttgtcaaacctgaagattaccaagggctgcaagttgaacctgataaagacttggtaacgctaataacctgcacaccttatatggtcaattcacatcgtttgttggtgacaggatatcgagttccttataataaaaatatggcaaaaaatattgaaaatgctgataagtttaacaatatcaagcaagctcttattattgttggcatcattttattaattgcattgcaatttcttttcttgtataagcgcatcatacgtatcaaattagctaagaaaaagtttgatttatcattttatcgtttagatgctgatggtaatcccgtttcatctgttgcctttcaattgttttctaagaataaaaaagttgctttaaaaagagatggagaatcattaattcgccattcaaatgatgaagggcttgttacatttgatgatattccaggcagactctactatgttaaagaggctacaactaacaaaaatagcggggttattgctggtgtaaaaaagctaaaggataagaatatgaccttttatccaactaaaaagtcaaaaccttttttccattcggataacaataaactgtggattattagataatgtatgaactcaaaaaagtaaatatatttcgatttaatcttaccaattctctcgtgctataataaaacaatgaaagaatttttaacaaacaattttgagcaaacacaaagtttagctagtagaatagcatcatttgtttatcctggtttagtgatcacgctgaatggtgatttaggagcggggaaaacaacctttacccagggattttcacgcgctttaggtgtgaagtcaagggttaagagcccgacatttaatattatgaatacttatatggcgcgtgattttcccatttatcattttgatgcttatcgattggaaatgactggtgctgctaatcaaggattcgaggattttatcggtacggatggtgtaacgcttattgagtggccgcaatatatgaatgatttgttgccaaataatcgattggacatcacatttactcgaggtgaggatgataacgaacgaacaataagtatcgcaggtgttggttcagttattgaaattgaggaaaaactatgacattcgatatgagccagccgattgcgttcagcttagaagaagccagcttagctagagctgctgaatggcaacaattaattcaagaattaatgacggaaacagatacttttttgattgcaagtatgcgtgatggggatgaagtacctgtaaaaaacgatgcgccggcgattactttgttgttgattgctgaacaaggtgaacaatcattaccggtaggaataggatctatcgaaaatgaagaaatcggtgtggctattttgaaacaatttcacggtgctggtcttggtcaggatttaatgcggtcacttctggactgggctaaacttaacgggttatcaaaggtatggttagatgtacaaattgataatgacatcgccgtgcatatttatcagaaatacgggttcttaagtgttgatgaaaaagagcactttaccttaccaaatggtcgtgatacagagttacaaagaatgatcttggagttataactatgaattttgtagcaatggattttgaaacagcaaaccgcgaaaagcattcggcagtttctatagccttagcaattgtgcgtgataatcaagtagttgataaattttattcattaatcaagccggaaacaacgtttagctcgtacaacacagctattcatggtctccatcgacaagatgtagctgacgcgccaaagtttcccgaagtttggcaaacaatttcaccttttttcacagaaaataaattagtggtggcccacaacgcatcatttgataatagtatcttgaaaggaacattgcagtattacgatattgatgaaccgcattatttgttgttggatacggttcaaaccagtcgtaaattatttccaaatttcgaaaatcataagttaaacactgttgctggtaatttagggattacattggatcatcaccataacgcgcttgatgatgcagtagccgcagccaatatcttaatttatgaatctaatcattttggagcagaagtacttaagccatatgttaaaaataaataaataaaaagccgtgcaatttatgcatggctttttatttatacattaatttcgagaagaatcggtgcgtgatcctgacgtgcacccgtatctataacacaggattctgtgacgttttcagcgattcgatcactaaccaagtagtaatcaattcgccacccggaattattgattttacttgttttactaatttgtgcccaccaagtataaacacttggtgtgtctggatttaatgatcgaaaagtgtctgtaaatccagcatccaatagtgctgaaaacttttcccgttcctggtcagtaaatccagcagaatgacgatttggttttgggttttttaaatcaatttcttggtgcgcgacgttcatatcaccactaaaaataactggtttggtagcgtctaggcgcttgatatattcacgatatttatcatcccactcaccacgttcaggtagacgtatcaacgagcttccggaattaggtgtataaacagttgataggaaaaaagttggaaattctaaggtgatgatgcgtccctctaaatccatgggacctggcgcaccaatagtaggatattccacctgaataggttccactttggaaagcaccatcgtgccagagtagccagagcgcgcagtactagaatttacatacaaatgatactctggaaaaagttctgcaatggctgtcgcttgttttttagttaagcctgttgatttcaattttgtttcttggatggcaaaaacgtcagggcgtatggtcgcaatttcgtttaatgtgctccaagtcatttcaccacggacacttttgtgttcaactgcagcattgatggaatcaatattccatgagataaatttcaaattttcgtccccctgagagttatataaatattttaacatactgtttgttttcacgtattagcgagcatatcgatgcataaattcaggtattgaggcactgatttctgtgggtagtgtgatgtagcgggtttcagctagttcgtcagcaatagcagaatgagcatagaccgccgctaaaattgcttcggaaaacgacaacataaactgtgccgtaaatccagcaatcattccggcgagtgtgtcacccatgccccctgtggcctgataaggtccaccaactggtatttcaaaagcgcagtcattggtataaatttgagtatgatgttgttttaaaactaaaatcggttcaacattcatcctttgttgcgctagcatattaaacgcttcaaaggcttgttcattgattgtcacaccacttagacgttgccactccatctgatgtggtgttaaaacgagtcgcgattttggccactttagtttatgtttagcaactagagttaaggcagaaccgtcaacgatgagtatttgacgtggcaaaatagcatagaaggtatgttgtactaaatcaatacgatcgcctaaacctgatccgattaaaacaacgtctgattttttaatatactcggtcagatcctcattaaaatcaacaaccattgcttctggtaggtgactatgtaaagcggtaaagtttgatggatctgtggctacggttactagtccggcaccagaattaactgcagccaatgcattcataatcactgcaccaccaaattgtgccgtgccgccaatgattaaaacacggccataggttcctttgtgtgagtccttggctctttttttaataactcggtataaaatatcttcagttaatgttttcatagtttaatccttaacattattctacacgatagttttgtttaatgcacaaagaaggtgataggagtgctcatctagcgtgactttttatgtgactcattatgtagatagtgtacaatatgtttatggaaaaaaatagttttattctctctgatgaggaaaaattgtcaactgaacaagtgcatttgattcaagatgtggttgactttgcaaatcagggtttgaagcaagaaaaaaagaaagtatttattattgaagggggcgctggttctgggaaaagtgttgtactatttgaaatatttaaacaacttcaacatgctgttttaaataatgagtcatcagcactttatcaaactaataattatttactagtcaatcacgctgaaatttggaaaatatatcgtaatttagcagggaaaactgaagaattaaaaaagaaacagttcctaaaacccacaacttttattcatcaaatggataaagagcagcgtcatgcagatgttgtattaattgatgaagcacatttactattaactgaacctgatcgctacaataaatttaatcaaaccaaccaactggtcgagattgtcaaacgtgctcaagttatcattttagtttttgatagccatcaagtcttaaaattcaaaagtatgtggactaatcaaaggttggaacaaatcgtttcacagtacgcaccaacgcgttatcaattaagtaatcagtatcgtatgctaggtaataacgagcatgttgttcaatggattgacaatctaacgcaaaataaagaaatttcaacattaggcctcgttgacggatttgattttcagattttttccaatgctaatgatctctacagaatgattcaacaaaaaaataagcaggtaggaatgtcacgtttgttagcaacaacggattatccgtataccgttaatcgcggtacctggtatgtgacggttgatgatttcaaattaccttgggatcagttagacacaggtacaacaccatgggcattgagaccggacacaattaatgaagtaggatcagtgtacacaattcaaggttttgatttgaactatgctggtgtgattattggacccagtatcacacttgatgaagataaaaataaaatcgtggttcataccgaaaaatatgaggataacgccgcttttcgacaaacaaagggtcattcatttagtgagcaagagaaagaagctattatgctgaacgcgctaaatgtgctattaaagcgtggccgacaagggttatatatttgtgctgcggaccatgcattgcgtagaaagctagccacgattattaaaaaatagtggttatagcgctatatagtatatggatactttgattatttaatccttgttcctgacatgaatattagaaaaaaatgccataacagggtataattatcatatgagttactagaaaggttaaaaaaatatgacagttgattggaaacaagaaacagagaaacgtaaagcagcctatatcgaagatttaaaagccttattggctgttgaatctgttcgtgacgattcacaagcaacgcctgatgcacctttaggtcctggaccaacagctgccttagttaagatgttggctattgctgagcgagatggtttcactaccaaaaatattgataacattgtgggctatattgaaattggtcccaaagatgctgatgaatatgtcgctattttgtctcatgttgatgtgatgcctgcaggcgagggttgggataccgaaccatttgaacctgttgtaacggatgataagattatcgcccgtggtgcttcagacgataaggggccaggaatgtcagcctactatgctttcaaaattttgtctgatttgaatgtgccattgaagcgtcgggttcgtctgatttttggaactgatgaagaaaatgattggacggggatgactcgttactttgaagttgagccagagcctgtatttggcttctcacctgatgctgaatacccaatcattaatggtgaaaagggtaacgttcaagtaatcattaaaggtgaagccactaatggtggcactgttaagcttgttgattttgagtctggattacggacaaacatggtcccaggtattgctcgtgcaacggtaaaatcatctcattcagaaaaaattgtgacagaattccaagagtttttggtagaaaatccaaaggtatctggttcaactgaaactgatggtgagatcatcaaatttgtcttaaacggtaagcaagttcatggggcaatgccagaaacaggagaaaatgctgggacttacttagcaaacttccttcaagactttgattttggtggtacagctaagtcattcttaacgtatttgggcacaccagcacacaatgatactgttggcgaaaaattcggtgttaagtatactgatgatgtgatgggacctttgtctatgaatgtcggtatccagaaatttgttgatggtggtgaggtctttatcaactttaatttccgttatccaaagggaatcacaccggaagaaattgaagcgggtcttgcttctcaattgaatggatgggatgtgaaaccaactatcggtggacatgctcaagtgcctcattatgttgcacctagtgacccaattgtggaaacactacttcgtgtttatcatgatcaaacaggattgccagcacacgatcaagtcattggtggtggaacatacggtcgcttaatgaaacgcggtgtcgcttatggcgcattattcccagactcaccagacacaatgcaccaagttaatgaatttgctctgcttgatgatttgtatcgttcaatttcgatatacgcgcaagcaattgccgaaattactaatttggactaaacagctctttagggctgttttttatttttgtttaattgatttaaatttaatgttgaaacgctaaaatagtaaacaatcaaacaaaggagaaacgactatgacactattaattattgtagctgtaggtttaattggtttttcattgaaaaaagttttacgtgtcggacaaccgcagccagttcgtgtgaaaaatgatcgctaaataaattaacatcctcttatattcgatataataagtgtatattatcatgtgccttattttgagttaaacaagtatcgatgtatggtgatgaatgaagtaaatattaataaaaacataataatgataatagtattagcattattatgtttttttatgagcttaatgttagaatggtgtttattattaatccaaggagtacagtagttctatgtcaatccaaaattttctgatggaattaaaaaaaagtaaatgggtagatttgtctcatgaatttggaccaaactcaccgcatttcccaaaatttaatgcggcctctgcaaaaacgatctttactaacgaaaaggatggctttttggttaaagaatttagtttcgtgggtcagtacgccacgcatattgacccgccaattcattttggtgctaaaagtggcgaatgggttactgacattccgttgaaagatttaatagccccattagttgttattgataaatccgacgttgtcaagaaaaatccggattattcactaacagttgctgatattaaagaatgggaaaataaaaacggcttaataccagaaggtgcttttgttgcttttagaactgattggtcaaaacgctggccaaatcaaaagttaatggataatttagatagtgatggtcaaaagcactatcctggatggtcagctgaggccattgaatatatttatgaaacgcgccatgcaatagctaatggtcacgaaacttatgacacggatacagctgtaaatcaaccaacaaaaggttttatagctgaagaactagttttgaggtcaggacattatcaagttgaaatgctaacacatttggatgaagttccggctaccggagcaattatttctgttatgacacccaagtttgagaaagcgccaggttttccaactcgcgtaattgcctacttaccataatttgttgtagggtgcacagctataataatgaaaacgccataaaatgctatttctaaaaagtatgtcaatttgttttatttgaagcgataaaaatagataaaatggttgtgatattcttgaatttagtctaaaattatatagtattgaaaactcggaggaaataacatgtctaagtggacaccagctgcggatgaaaaaaaccaaggcacattagaatttgaaatcgcgcgtgcgcaagttgaagaaggtttggaacaagctttccaacgtaacaagaacgaagttagtattcctggattccgtaagggtaaggtaactaagcaactcttcttccaaaagtttggtgaagaagctttgtaccaacaagcaatggacattgttttgcctgctgcctatgaagccgcaattgatgaagctggtatcacaccagttggtcgtccaaacatcgaacccgtttcaatgaataagggtgaagcttggactttaaaggctgttgtcaagactgcccctgctattaagttgggtgaatacttgaaccttgaagttgaagcacaagacgaagaagttgctgatgctgatgtagatgctgaaatcaagcgtttgcaagatggacaagcagaattagttttgcaagaagaatcagttaaggctgaaaacggcgatactgttgtgattgattttgacggttcagttgatggcgttaagtttgatggcggacaaggcaaggacttctctctagctttgggatcaggtcaatttattcctggctttgaagaacaattagttggtcacacagctggtgaagatgtcaatgttaacgtaacattccctgaagactatcaagctgctgatttggcaggcaaggaagctttgttcgaagtaacaattcacgaattgaagcgcaaggaattgcctgaattagatgatgaatttgccaaggatgttgatgaagaagttgaaacattagctgaattgaaggaaaagacatctaagaagttagctgatgagaaggcacaagctgctaaagctgcgtttgaagacgctgttatttctaaggcagttgataatgcctcagttgatggcgatgaaattccagcagaaatgatcgatgaagatgtacatcgtcaaatcgaccaatacttgggacaacttcaacaacaaggtatttcacgtgaaatgttcttccaaatttcaggtcaaactgaagatgatttgcataagcaattcgaagaaggtgctgaaacacgtgtaaagactggcttggtattagaagcaatcgttgcagctgaaaagatcgatccttcagcagaacaagtttctgaagaagttgctagcttggctgcgcaatacaacatggaagaagataaggtgcgtgctgctatctctgaatcaatgttgaagcatgacattgctatgcgtgaagctattaagaaagttactgattctgctaaagcagtttaagttcaaattagtttgatttaaaaaacacttcagtttgaagtgtttttttgtgcacttattatctgtaattaaaaaaataatattttgataacaccaaaaatggtgaatcttatgccttacgctgaacctgagcgtaaggtataatgaaagggtagtgtcattcataacagtgtggagaaagtaatggtacagacagaatcaaagcttgagaatcagttgattgcacagctcgggaaatctggttggcagtttcgaccagaattaaatcattatagtttgattgttaatcattttcgtgtgcttttaaatcgacggaatattgacaaactagatggtacaccactgactgatcaagaatttcaacgatttttaaatgaaattgtgggatctaaatcaatctatcagttgggacgctatttacgtggcgatgatcaatttcaaggtggaagagcacaaatacagcgtgacgatggatcagacataacgttgtcgtttttcgatcctcgtgacgcggaaaataatgtttatgaagttgctcatcaagttgttgtgaatgacaaatatgaaaatcgttatgatgtcacattgctaattaatggtttaccacttgttcaaattgagttgaaacgtcacagtattgaaatgtcacaagcgtttcaacaaatattgcggtatcgtcgtgagtcatttaatgttggtggtagtttatttcgatatttacagatttttgtgatcagcaatggcatgtcatcacgttatttttctaataatgatggtgagttaaataaaaattttattttcaattggtctgatgaaaataacaggtggattgatgaaattgaaccttttactgccagttttctttctcctctgaatatccatgaaatgatttcaaaatacacaatttttgatgcggaccaaaaagtaatgaaaattatgcgcccatatcaggtgtatgcgcaaaaatccatcatgagtcaggctgaaatacatcccgctacaaacgggtatgtttggcatacaaccggttctggcaagacaatcacagcttttaaagccgcatctcagttggcacttcatacagacgcacagaaaattatttttcttgttgatagacgtgatttggattcgcagacaattaataattttaatgcctatctaccaaggcgtgcggatggacaatcgtcaattgatcgtacagataatacgtccgttttagttgaacaacttaaaaattcgacagacacgttgattgtgactactattcaaaagcttgccaatgctgtaaaaaatccgcgtcatcggtcagttttagagccatacaaagaacagcgtgtgatttttattgaagatgaggcacaccgaacccaattcggtgaaatgcgtaaacaggtcaatagctggtttaaaaatgcacaacattttggtttcactggaacgcctatatttaaagaaaacataggggcagatgggcgtacaactgacgatatttatgatacccgtttgcatacttatttgataaaagacgctgtacgcgaccataatgtattaccgttcaatgtcacctacatcaatactattcatagcaaagaagatattgaaaatttaaacggagaagttgaagcgctcaatattaaagaagtgtatgagaatgaaaaacgcctaaatcaaattgcacaacatattatcctcaatcatagtagcaaaacgtataatcgccaatataacgctatttttgctgtttcagatacgcgaacagctttaaagtattacgatatttttaaagaaataaacaatgatttgaaagtaacgacgattttcacatgggccgctaatgaagaagataatgacgagcaccaaaaggacgacacattaacttcccgtcatggcttggaaaaagtcattgatgattataacgacaaatatcaccaaaacttcagtacagatacattttccgatttcttcaacgacgtatctaaacgtatgaagaatcatgacgccaaatcacctgaaaataatattgatgttttgatagttgtcaacatgttcttgacaggttttgatgcaccgacactgaatacgttatatgttgataaaaacttgcaataccacggactcattcaagctttttcacgaaccaatcgtgttcaaaaagcgccaaaagattacggcaatattgtggcataccgtaatatcaaaagtaaaacagatgaagcggtccagcttttctcgcaaggggacaaggcagcgtttttcgcaccgagttatgaaaacttaaaactagattttcaacaagcaataagcgccttgagggacaaggtagctacacctgaagacacaaatcggttattagatgagggtgaaacagcggaacttgaatttatcaaactattcagaaatgtcatgtcacttcaaagtcgtatcagcgtttacgaagaatttgattgggcggaaattgaaacagagctcgactggacgcaacaaatatttgatgatttcaaaggcaagtatgcaacattctatgaacggcacaaggcacgacaaaaagaaaaagcatcaatcatcgatgatgtagatttttaccccgagctcctgatggttgatgcaattgatgttgattatatcaatcgccttatttcacaaatcgacttatcgtcacctaatgcacggactgagggtgtagaaaaagtaaaaaaagcccttactaacaataccgaacctacgctgttttctaagcgtgaattgttagaacagttcttggattccgttattccggagttgaatgatgatgcggacattacaggcgaacttaaccatttcttggcgtataagcgtcaagctgaaatttatcattttgcagaagaacatcgtttagagccatcccagttagcagaacaagtcgctgaatatgaagtgagtcaacatgaaaattctaaagcacttagtgaactgaccacgggcatgacattcaaagaaaaaagaacagcaaaacaatctattaaaaacttcatcattgaaactgccaaaaagtttgtgatgaattagagagaacagacatgtcaaataccaatcaaacgcagcaatcgcaacaagctgaattacaaaagcgcctctggaaaattgctaatgacttacgtggcaatatggacgctaatgaattccgtaactatattttaagcttaattttttatcggtttttatcagataaaatcgaagattatgttaataacaatttattagaggctgaagatgtcgactttattcaagcctatgaattagatgattatcgtgagggaatccaggaggaggctttaaacgatttaggcttctttattgagcctaaatatttgttttcaactttggtcaaagaaattagccaaggtaaatttgatattgaagatttacagaatgcagtgattgctgtggaaaactcgaccattgggcagcgctcggaagatgattttcgcgggttatttgaagacctagacttgtcatcttcaagattgggtagcacgccagcagaacgttctaaaatgatagctgcggtgatcttaaatttacacgatttagaaattaaacatgatgaaattgaaattgatattttaggagacgcctatgagtatctgatcggtcaatttgctgccaatgctggtaaaaaggcgggcgagttttacacaccacagcaagtttctaaaatattggctaaagcagtgactttgggtcgtgagacgttaaaaagtgtgtatgatccgacgatgggatctgggtcattattgctgcgtgtcggagatgaagccaaagtatacaattattttgggcaggaacttaacggtacaacttataacttgggtcgaatgaacctcctgatgcatggtgtgaactataccaactttaatgtgcaacaaggggatactttggaaaatgatcattttggtgatcagaagttttctgccgtggttgctaacccaccatactctgctaactggaatccagatggtaagttggacgatgaacgattccgagcatacggtaagacagcaccaaaatcaaaagccgattttgcttttgtggaacacatgttatatcatcttgctgaagatgggacaatggctgtggtcttgcctcatggcgtacttttttgtggtgcgggagagggcattattcgccgttatatgattgaaaatatgaatgttttggatgctgtgattggcctgccagctaatttgttttacggtacaagtattccaacgactgttttagtatttaagaaaaatcgttcgacgaaagatgtcttctttattgacgcttcaaatgattttgataagagtaaaaatcaaaatacgctgaccgatgctcatgttgacaaaattattgagacctatgcaaaacgtgaaagtgtggataaatatgcacacgttgcaagttttgatgaaattgttgaaaatgattttaatctgaatattccacgttatgtcgacacatttgaagaagaagaacctattgatttggcacaagttgaagcagaattaaaggctgttgatattgaaatcgccaaagcgcaagccgaatttgacgcaatggtagctgaattagtggagactaaaaatgactgataaaactatgcctgcgttgaggtttaggggtttttatgatgcttgggaacagcgtaagttgggggatttgactaatagttttgaatatggacttaatgcttcagctaaaaaatttgatggaattcataaatatattcgtattacagatatagatgattcaagtcggaagtttaatagtgagtctataacctcaccagatatagatttcagttcagctgataattatgaattaaaacaaaatgaccttttgtttgctcgtacgggagctagtgttggtaaaagttatatatacactgaatctgatgggctagtttactatgcaggattcttaataagagtacgaataaaacctgaatttgattcgaattttgtatttcaaaatacatttactagctcttatgaaaattttattcgtattacttcacaacgctcagggcaacctggtgtaaatgcaaaagaatacgccagttttgagataagtataccaagtttagaagaacaacaaatgatcggttctttattcaaacaattcgacaatctaatcactcaaaacgagcgtaagattgaccttctaaagcaattaaaacaggcgtatttgcaaaagattttcagtcaggaactgcgttttgctggctttagtgatgcctggaaagagtgtgagttgggagaagtttttgataccgtcacagattatgtcgcaaacggaagctttgaatccctgagaaataatgttaaatcatataccacagaaaattatgcatatatgatcagacttcaagatgcgtcaaatgattggaaagggccttggctttacactgatcaagcagggtatttgtttttatctaaatcaaagttgtattcgaatgatattataatgtctaatgttggtagtgtaggtaaattctttttagtaccagatttagataaacccatgactctagcgcctaatgctgttctgattaaatcttcaacaagtaataatctttttctttatcaaatgatgattggcgaaaccatgcaatcgaagataaataagaaagctacaccgggtgttcagtctaaaattaataaaacagatttcaagaaaatcacaactaaaattccacaaaaaaaagaacaacaaaagattggtacgttgttcaaacaactcgacaacctcatcgcccttcaccaacaaaagctcaacctcctcaaaaaacaaaaacaggcttttcttcaaaaaatgtttatttaaattccagcaaataaccagcaaattataaaacggtgtctatcttacgtagacaccgttattttttacatcaattgtgctaaatgtttcatgactagatcattatcttgattttctaattcttgaatgacgtgaatgtaagttttttgtgttgttgtcatatttgaatgtcccaacctacgtgccaccgaagcaactgatacgcctgcgtaaagcaataatgaggcatgtgtgtggcgcaggccatgaattgagataactggtatctcaacttgcttgcaaagtgtggctaatctgtcattcactgtcgcattgtaaacacgtccacggacaaatatcggctcatctcttggtagattgcgaacgatgactgaaaatcgtatcgcagtttgccaatcaatttgtacttttcggaccgatgaattattttttgttggcgcaaagtcagcttgtaccgctttataattccatgttttatcaattgtgataatttgtttttcaaagtcaaaatctgctggcgtcaaccctaaagcttcagcaaagcgcaaccccgtttttgtaatgagtaagataaaataatcccaattaacttcgtcctgtaaattcaattgttttagtagagcctgcacctcaaattggttcaaaaattttggcttatgcagtcgctgaacagttcctttaaccacaattttgcgagtcggatctcgttttagaatatcctcttccatggcatctataatcgagctttttaaatgatgatgaaaatccataactgtctgacgctcatgattttgcgcgaaatcattaagtaattgttgataagttgaacgtgagagtttacttgttttgagtcttggtgcaagcttaacgagatgttgatgtgttataacatatttttgataagtaacaggtctgacagcgccttgtttataaagcgtcatccagtccttaaaatatgcgtgaaacgtctgattttgtgtcataatagacacctccaaataaaaaattagtcgcaacttgttgttggaccaatttacattaaaccatgttaatgttagataaacattttttggaggtaggcttgtttttgttttttgaggaggttgagcttttgttggtgaagagcgatagtattgtctagttttctaaagaaagcggacatcaaaatttgttcttcgtaattagggaaagttatatgaatattcatgaaatcatcatagttaatatttaacagtccatccatacgagccccagaagatactaattttcctagttctctatcaggtagcttagttgaaaacatatactcaatgaaatcagctgacgtattcgctaacgctttaaaactatggtaaactcttggaacaagtgcttcttcataattttttaaactgaatacaacgccgtatttagctagcttagaatttccatgattatacgatagttcgccctttttcaataaggtataattctttttctcattacctgaaatatctccagagaatctatctttttgatctaaccaaccactgctagcagacattgttagtgtaggtaaatccattctcccgtcgttagatcttactcgctcagtaacatcttttaacttacgctctttccaggcattactaaagccagcaaaacgcagttcctgactaaaaatcttttgcaaatacgcctgctttaattgcttcaaaagattgaccttacgctcgttttgagtgattagattgtcgagttgtttgaaaaacgaacctattttttgttgttcggtattaccaggaatcagtatgtcctgatttctaattaattcagagttcaaatttacttgactaccaggttgtccatattttttccactggggtctaaacatttcaagccactggaacataaattctctttcaaataaaggatctaaaaatatcaaaaatccatcgtgtacgcctgttttaatgtaatttactaatggtttaccaactgtggcagcgatgcttaatagtagatgtggctctgtcaaaactcgtgttttttcttggcctaatttagatatgtgctgatcaagatgataaattctaccattttgctctgttacatctgagattcttaaccaaccaatgttgctctctttgtcaaaccattttgggtcttgaattggtcttgggcttgctccacgaacaatatttgctaaatctcccaacttacgctgttcccaaggaaactatcatgtcataaatccaaaaatcctagaacttaagtcaacagaaaaacacaaaaataaaagaaataagatctaaaatataaatttgaaacacggtttataagactgccataaaatagtataatggtaagatacgagctgcatataaaatatatataatctgcataaaaatgtagcggatcaataaaaaaggaaaatcatggcgaatacaccaaattttgaagaagaaatacactgcagtttttgtggaaaatctgcaagtgaagtaaaaaagattgttgccgggccaaatgatgtttacatttgtaatgagtgtgtcgctttggctgaaggcattattgaagaagaattgactgtagatcgtgcagcagaagtgttgtcactgccaacaccacacgagattgttaatgagttaaatgattatgttattggacaagaagatgctaaaaagactctggcggtagctgtatataatcactataaacgtattaatgaaaacgtggcgccaacattagatgttgagctacaaaaatcaaacattgctttgatggggccaactggttcgggtaaaacttatttagcacaaagcttggcacgtattctgaacgtaccattcgcaattgctgatgcaactacattgactgaagcgggttatgttggtgaagacgttgaaaatattattttgaaattactgcaagcagctgattttgatgttgcagcagctgagcgtggtattatttacgttgatgaaattgacaaaattgctaaaaaatcagagaacgtctccatcacacgtgatgtttctggtgaaggagttcagcaggcactattaaaaatgcttgaagggacaactgccagcgtgccacctcaaggaggccgtaagcatccacagcaagagttgattcaagtgaatacgaccaacattttgtttatcgttggtggtgcgtttgctgggattgacacaatcattaaggaacgactgggcgaacgagttattggttttggttcagatgcaaatgaaaacgctgaggctttgaatgacgacaatattttgcatcatgtgcaaccagaagatatgaccaagtttgggttaattccagaatttattggtcgtctgcctattgtaactgtgttagacgagttgactatttctgatttaacaagaattttgacagagcctaaaaatgctttaattaagcaatacactgctcttttgggtctagatgatgttgaacttgaatttcaaccggatgcattggatgcaatggctagtgttgcgattaagcgacacactggcgctcgaggattacgctcaatcattgaaaatgtgatgaaggatgtcatgttcgatattcccagtcgtgatgatgttgctaaagttattattaccaaagccagcgtggaacagggtgaacagccagaactgcaattaaaaaaggtgagtgaataaatggatgtacacaatgtcgaaatggtgatgagtgctgtatcagcgtctcagtatccaacagacggaaaacctgaaatagctttggttggccgttcaaatgtcggtaaatcttctttaacaaacacactaatccaacgaaaaaattttgctcgcacatcttcacaaccaggtaagacacaaacgttaaacttttatgatgttgaagataaattatatttcgttgatgttcctgggtatggatatgctaaagtttcaaaggcccagcgtgaagctttcggtgtaatgattgaagaatacatcactagtcgtaaacagctacgtggtgttattagtttagtagatgcacgccatgagcctagtgaagacgatatctcaatgtacgaatggctacattactataatattccaattttagttgtagcaactaagtcagataaaatttcgcgcggtaagtttaataaagctgaatcagtcattaaaaaagcattaagctttgataatgaagacagtgatttccaatttttctcatcggaaacaaaatatggtaaagatgaagtgtggcgttggattgaacaacatatctaaaatgttggcagaaatgccaacatttttttattttcgccgctaagttctattggttgacgtatcttaaaaccagcgtaaaattaaaaaataaaaagaggattttatgacaaaatataacgatgaagaattgcgtgctcgtttgacaccggaagaatacgaggtgactcaacatgcggcgacagaacgcccgttcactggtaagtatgaccaatggtgggaggatggtattttcgttgatgttgtcagtggtgaaccattgtttagttcaacggataagtacgattccggctgtggttggccatcatttacaaaaggaatcgatgacgacgagcatttacaagaaaatacagatcgttcattaggaatgacaaggacagaaattacttcaaaagaagcggcatctcatttgggtcatgtgtttaatgatggattacctgaccgtggtggcttaagatattgtatcaattcagctagcttacggttcattccaaaaaaagatttagaaaaagatggctacggcaaatatttgaaattgtttaaagattagattaatagctggtttttggacggcaaaatctccctaaactaatcggttttttaggctatttactgatataatgaaataaataattattagggagaatctataatggttgaggaaccagtctggcatcgtttttggcgctactttaaccccgtgaacattttcaaagaattgttatttggctggaaatgggctgaaggtgtattgtttttagtactgattttactgcaattactagtttggacactgggtgttgttcacaatagcacgctcgattggtttggcttggcaaccgggatgatgaacattatcactgttgtattggtcgccaagggtcgtataacaaattatttttggggcctgatttattctgttatgtacatgccattggcctttcagtcacagttgtttggtgaggttgctttaagtgcattttgggttgttatgcaatttgttggtgttgcagcttggcttggctttatgaaacgcgataatttatcagaaaaagacagtcaagatgtggtagcgactaaatatatgaccttcaaacaatggcttctagttatcccagtattcctagttatattagtgattgttggtatgattttacatcaggctgggtcaagacaaccgtacatggatggattgacaacaaccatatcaatgggggctcaaattctgcaaaccgcaaagtttgcggaatcatggtatgcttggctactctttgatatagtcgaaattgttttgtggggacgtgcttggacgggacatgcggatcctagtgcgtttgctatgttaggtatgaacctcgccttatctgtcaatgctatatacggtattattcagtggcgaaagttaaccaaaaaagaatgaacatgcgcaatgttcaaattttaataggatataattaataaagtcatgagaacaattgcagggaacttattcacagatgatcttcaaggtgacaaaattggcgttttctttggtacgttagcaccaatgcacgtagggcaccaagcagaaatttataaagcggctgccttaaatgatggtgtcgttgttattgcttctggttacacaaacgatagagggtaccaaatcggattatccgttgagaaacgttttcgctatttgagagaagcatttagtgacgaaacagatattaaagttgattacatcaatgaagacaatatcccaatgatgcctgatggttgggatgagtggacacgaataattgttgaaacggttaagcgtaatattgttaataaagatgcaacgattacattttataccggtgagaaagattacaaaaatcaattagaaacaagattaccgaagaacggtcagttcaaagtgagcttgatggatcgcactgtattaaaaatatcagcaacagatattcgaaaagatcctattggaaactgggattacattaaccgtgtttttcgacgccattttgctaaaaaagtcacggtgatgggatcagcttcaacaggaaaatccacattagtacgtcgtttggctcgaacaagtaattcaccattttcagaagagtatgctcgtgagtatcaagaaaaatcgaatgttagcgatgaagagttagtcgttaaagactacatccgtttaattcaagggcaatatgatgcgaactcaagagaaattaattctccagctaacaatggtctaacgatttttgatactgatgcaatggtgaccaaagtatatgcagatatgtggttaaacgatgtggataatgcgcagctgaagccattgtttgataatacaattggtgaggagttgattgacttaattctacttattccaccggtgactccttatgttgatgacggcttccgaaatatgacaacttcagataatgattcgcgttgggctttccaccgccatttgttagaagtgattgaagaatatggatttacggacaaactagtaattcttgatgcaaaaggcgatagtgatgatccttatggatattatgcacgttacttacaagcactagatgctattcaaactagaacaggatttaatattaagcatatttagagaaaaactggttttataccggttttttttgaaaggtaaaaatgataaaattacgacaattcaaaacagaagatttagcgttattttgggaaacagcttatagtgatccgcaagctgagtggactaaatggaacggaccatattttaaagatgtgttacctaaaaaagacgattttatcaataatattggccctgaaagattcgtgaataatatgaatcggcgggttattttatacgacggtcaaattattggtgatgtgagtgcatattttgaggatggacaattaaaatcttggcttgaagtaggaattgttatttatcaacaagcaacatggcaacaaggaattggcacccgtgcattaggtatgtggttggaaatattatttgagcaatatgacagtttaccacatattggtttaaccacttggtctggtaataaggctatgatgcgtgtaagcgagaaactgggcttgaaattagaaggacaaatccgacaagtgagatggtggcaaggtcagtattgggatagcatgaaatacggcattttgcgaaatgaaatgacgcctataagcccctctggtaaaatagagttatgatgaaacaatacgcacaaatcattgttgatgtgccaacaatgcaaactgatcagccttatacctatgccgttccggagaatatgatagattcgctattgttgggcatgcgtgtgacggtgccttttggtcgccggaatgtgatgggatttgttgttggtttaatcgcttcaactgacttaccagaggaacaagtgcgcccaattcagcaaatattagatttaacaccggtattaaatacagaattactaaatctatctgattacttagccagtgaaacatttgcttttcgaattacaattttacaaacgatgctgccaaatgtgtttaaagcaaactacgagcgtactttaaggattattgacgaagtggatgacgatgtacgtgatcgtttatttaaagggcttgatgagatagcttttaaaacaggcgactttactgagcaagatatggcaactttgcttaagctacgtcgtcaacataaaattgatgtagaagtggcagtgcatgacaaggcgaagataaagacacaattagcttatcagttcagtgatgatgttgaatttttggaggatgagttaagaggattacgatcttcagcaaagaaacaagaaacgttgttgcagttcatactcggtcatttggctgaaacatgggtgaaaaaggacctgcaggatgttatcgatatcagtgacgccgtcttaaaccaagctgcaactaaaaaatggttaatgaaaacaaaagtggagcttcttcgcgatccatttcatgctgaagttaaacaaacagcgttacttgagttaaatgcgcagcaacaagaggcctatgaacgtatttctggtacatttgatgcgcaaaggtttcaaccatttttacttgaaggtattactggctcaggtaaaactgaagtttacttacaggtggcacaacatgtttttgagcagggaaaaacggttctttttttggtgcctgaaattgccctcacgccacaaatggttagaagggtcaaaggccgttttggtgcccagacagcagttttacattcgggattaagtgatggtgaacgctacgatgagtggcgtagaattgagcgtggtgatgtgaaaattgttgttggtgcacgttctgctgtgtttgccccactgacaaatattggtttaattattgttgatgaagaacatgaaacaacctataaacagtctgataatccgcggtatgatgccagaaatatcgcactctggcgtggtcaatactatcaaataccggttattttgggctcagcgacaccttctttggagagccgtgcgcgagcacaacgcggtgtttatgaactattaacactgacacagcgcgcaggaggcgcaaaactaccgagcgttaatgtgattgatatgaaagaaacgctgtcacgaagaccagagaccaatttttcggaagaattgcgtatcaaattagccgaccgtttggcgaaagatgaacaaagtgtgttgatgctcaatcgccgaggattttcaagtttcgtgatgtgtcgagactgtggttatgttccatgtgatcctaattgtaatttagctatgacactgcacatggacacacatacactgaagtgccactactgtggtcatgaagaaaaaatacccactatctgtgcgcaatgtggttctaaacgtatacgttattatgggactggtacagaaaaggttgaagctgagttacaagaattatttcctgatgcgcgggtgattcgtatggatcaagatacgacacgcaaaaagggtagtatggataagatgcttcaaaaattcggtaatcatgaggcagatattttattaggcacgcaaatgattgctaaaggactcgactttcctgatgtcactttagtcggtgttttgaatgcagatacctctttgggattgccggatttccatgccagtgaacgtacatttcaattgttgacccaagttagtgggcgagctggacgggctaaaaaacctggtgaggtgttggtgcaaacgttcaatccacagcattatgcaattacttatgctcaaaatcatgattatgaaggtttttatagacaagagatggccgtccggcatgctggaaattacgcaccgtactactacacggttcagatacaagccagccattcagatgaaaatcaagcagccattcaaatgctgaaagttgcgcgctggctacgttcgcatgctaagaaagatgtgattattttaggaccttcgccaaagccaatcgctaaaatgcgcaagcgctattactttcaaattatcctaaagtttaaaaaacgtaatgaaatggacacgttgctacaggaactacaaaatcgcgcacaaaaggctaaaggtgatttgcagctaagcattgatcgtgatcctgtctcatttatgtgatgtgttataataaatactgataactgtccgagattgctcggacatttttgtgttatcgtgcgaataaaaaataaaacaccctaacacagctgtttgagaggtataaaatgacatattcagtagtattaatgggcactccaagttttgcagtaccgatattagaagcgcttcttgaaaataataattatgatgtgaaggcggttgtgacacaacccgatcgcccacagggacgcaagcatactttaacaccaagtcctgttaaagttgcagcactggcgcacgacgtgcctgttttacaaccagaaaaaataagtggttctcctgagatgcaacaagtcattgatattaatcctgatttcatcgtgaccgcagcatttggacaatttttacctacaaaattattagacgcggccaaaattgctgcagttaacacgcatgcttcactattaccaaaatatcgaggtggtgcaccagttcattatgccattatgaatggcgataaagaaaccggtgtttcaattatgtacatggtcaaaaaaatggatgccggtgatgttattgatacgataaaagttccaattacgagcaccgataatgttggcacgatgtttgacaaattaagtattgctggacgtgatttgctattaaagacactccctaaaatcgctaccggtaatattgacccagtagtacaaaatgaagaagaagttactttttcaccaaatataccgcacgacatgcagaatcttaattttgcgacagaaacagcccaagaactagactggcatatacgtggtttatatccaactcatccagcttttgtgcaggttttggatcaacgcgtgaaaatcactgatgtgacacccttgcctgaattaacagcgcaagaaccgggcaccattgttgagaaaagcaaaaaacaattaaaagtggcctccgcaaatggtacggttgttcaaatcaaccgactacagccggcaggtaaatcagaaatggcgattagtgcctatttaaatggcgctggaaaagatcttgaagtaggtcagaaatgggcaacaattaatgagcgataaacgagtttacagtgacaatccacgtgttttagcagttcaaacactagccaaaataaaaaatggtgcatattctaatctacaattaaatcaagtgatcaagcaacataagctgggtgaagcagatactcgtttattaacaactttggtttacggtgtcattcagcatcgcttaacttttgagtattggcttgaacctttcgtaggtagcaaaaaaattgatccatgggttcgggagctgctatatacagctattttccaaatggaatacctagataagataccacagcatgccatctttaatgaatcaattgaagtagctaaaatactagggcatgttggaacaggaaaatttgttactgccatcttgcataacattagtcgtaaaggccttcgtagtgttgccgacattggtgatgacatacaacgcctttctattgaagcaagtttgccggtttggttggttgaagagttgattaagcaaaatggggatgaacgagcacgccaaatcattgctacaatcaatgatgcacctaagcaatccattcgtgttaatacgttactagctactgatcaagcagtggttactgcgctagaatcagaaaatctcactattacagcatctagcgttgctgcacatgcgtttttagtcagcggtgggcatgtggccagttctaaagcataccatgatggttggttaactttgcaggatgaaagtgcgatgctaccagtagaaagtttacatttgacgcctgaggttaaaagtattttagatgcagcggcggcacctggtggaaaaaccacgcaacttgcacaatacagcgctccagatgctgtgattacggccttagatgttcatgagcataaaattaagttaattaacaacaatgctgagagattacacgtagccgataaaattcatgcacgtgtcctagatgcaagaaaagttcctgaacaaattgacaaaaaatttgatcgaattttagttgatgcaccatgttcaggatttggtttattgcgtcgaaagcctgaaattagatatgataaaaccttggaagatgtcgaaagtttagctcgtttacaaacacaaattttggattcagttagccaaaaccttgcaaaaaatggtatcatggtttacagtacttgtacaatcttgcgtcaagaaaatgacgatgttgtaacaaattttttggaagaccatccaaattttgaattaattccaacggaaacaacgtataaattaaaattagatcatggcgaaaaagccttacatgtgtatcccaatgattaccatacagatggctttttcgttgctacattgaggaaaaatgattaatggcaattgcctatcgtacggatcctggatccaagcgccacgacaatgaagattatgtaggttcttttataaataaagttggacggacaatggtgatcgttgctgacggcgttacttcgaatgaaggcggtgaggttgccagtgcaatgactgttgagcacttcggacatgcttgggaaagcaatgatttggagacaattgttcctacaattgcgtggttaaaaaaacaagctaaaattgaaaatgatgctattataaaggccgggcaacgctttcaagagctgtcacagatggcaacgaccgttgttttggctgtattgtttgacgaaaaagttgtgattgctaatttaggcgattccaaagcctttttgttgcataataatcaattaacccaactgtcaaatgaccatattttaaaaaatgaaatcattcgtagaggggctatggccagtgcagatgctagtaacatggtacacgctaatagtgtgacacgatttttaggtgttgatgaacacgcagatattgaaatttctcaacacgattttgtggcagatgatattttatttctaacatctgacggtattacaaaagtattagactacaagacaattaagcaaataatgcgctacgaagaaccacttgatattaaagtttttgatatgattcagcaagcaaatgaaaaaggcgcaccagataacgtgacggcggtactcgtcacacatgaaaaggattagagatgttaccagatacactagttgacaatcgataccgtattataaaatcgcttggcgatggcggtatggccaatgtttatttggcgcatgatgaatttcttaatcgtgatgtaacgtttaaaatgatgcgtcttgatatgaaaaatgatgtagatttggcaaaacgctttcaacgtgaggccttatcagtaacagaactgattaatgacaatattgtccaagtatacgacgttggtgagtaccaaggttcacaatatattgtcatggaatatgttgatggtacaaatcttaaatcatatattggtgaacattttccaattgcatatcaacaagttgttgatattatgatgcaaatattaaacgcagtgcaggctgcacataatgcaggtattattcatcgtgatttaaagccacaaaatattttaattgacagaaatgatcaagtgaagattaccgatttcggtattgcaattgctaaatcagagcaagatttgacgcagacacataccgtgattggttcagttcattatttgtcaccagaacaaacccgtggaggcatggcatcagcaaagtctgatatctatgcacttggtgttatgctatatgaaatgctaacgaagcaagtgccgtatgaaggagatacgccggtcgcagtagcactaaaacatgcaactgctgatatgccttcagtacgtgattttgatccaagaattccccaagcactagaaaatgttattttaaaagccacagctaagaacccacaggatcgttatttagatgtctcagttatggctgaagatttaaaaacagttctatcgccacgtcgttcaaatgaacaacgatttgcgccaactgcggatattgaaaacgaaacgcgcattattccgatggaacaaattcaagaccagctcaagaatggtgtttcctctgttaatgttttaccggaggaagttcctgaggaaccatcagtaaaagatctgatcattgagtatggtaaaaaaggttacgctgttaaaagtatcgcaaaaattgttgaccggacacctaattatgttagaagtgtgcttcggggcaatggcatcaagtatcgtgaaaataaattacctaaaattttggcttttgcagtgctttttattgttgctattattgctatttttgcgtttattcatattcaggctagtcaaatcactgtgccgagcttatccaacttaacaagagccaaggctgaaaagaaaatacaagaagctggattgaatgttggtagtgtgacttcgacaacttcgacaaccatcaaaaagggcagtgttgtgcgttcaacgcctaaagaaggaactgacgtaaaaaaaggggacagtatcaacttggttatttcctctggtaaggcaaaagtgcgttttggagattatgttgggtcggattatgatgtaacagcagcacaattgcgctcgcaaggatacgaaattcaaaaagaacaacaagcgtcagatagtgtagctgcaggcataattatagctcaatctattaatgccaatgggaaggtagaccctacagccacaaaggtgactttcactgtctcaacaggaccggttaagattactgtccctgacttcactaaaagtagcacacaaagcgatgttcaaaattgggcatcacaaaatgatgtcactgttaattttaatacgacttactccaattctgttaagaaggaccatgttattagtcaatcaatccgtggcggatcaaagattacaaaagataacaccttattaattacgatttcacagggaccagaacaatcgagctcaagtagtagtagttcatcgtcttctagttctagcagtagttcctcaagcagttcaacaagtagtgaggattctagtactacatcatcggacagttccacatctgagagctcttcgagtcaataacaacgtgtctaaaagtcgatattatcggctttttttgttatgattaatggtatgaaaacaggacgaattattagatcgctcagcggttattacgatatacagttacccagtggtgacattcaaagaacgcgagctcgcggtgaatttcggaaatctaagcaaaaaccgctagttggcgattttgttgattttgagagtgaaaatgacgagggctttatttgggcaatccatgaacgggagaactttttagttcgcccgccaatagcaaatattgatattgccgttattgtgacagccgccaaggaacctgattttgcaccaaatttgttagatcgtcagttggtggcacttgaagctgcaaacgtaagaccgttgatatatttttctaaaatggatttgctggaaaaatctgaacatgagaaaataaatcacgtcgctaattattatcaaagtattggttatgatgttattttttcagattcaaaaagcgcttttgaagcgcttaaaatgatgttaaaagaccatgtttcagtttttatggggcaaacgggagctggaaaatcaacattactgaatcatctatcgccacaactcgggcttgaaacgggtgaagtttctaaagcgttgagtcgaggaaaacacacaacacgacaggtaacgttgattgaggtagatgaggctttgattgctgacacgccaggattttcttcatatgaagtgtttgattttcctgttgaagaattagatgattattttccagagtttgttgaaaaacgtcaagattgtcgtttccgtggatgtttacatctgaatgaaccaggatgtgccattaaagaggctgtagcggttggcacaatcacacagtcaaggtataatagttataaggcgttttatgagttgattaaagcgcaaaaaccaaaatataaaacagacaattaaaaagaggtatatcatgtcaggaatcattgcaccatcaattttgagcgcagattacacaaatttggaacgtgacgtcaagcttgttgaagctgctggtgcagagtatttgcacatcgatgttatggatggtacttttgtgcccgctatatcttatggtccaaattgggtcaagcaattgcgtccggaaactgatttagtgttagacgttcacttaatgattcaaaatccagaacgctttgttgaagaatttgcggatgctggtgcagacatcattggtgttcatgttgaagcaacaccacatattcaccgtgctttacaaatgattaagaacaaaggtgtcaaagcagaagttgttatcaatccaggaacgccagtatccgcaattgaagcagtactggatatggttgatcaagtactagttatgactgtaaacccaggatttggcggacaaaagttcttgccatcaacgctgcaaaaaattgaacaactacaaacattccgtgaggagcgtggctttgacttcgatattgaaattgatggtggcgtgaataacgagacgattaaatcagcatatgatgctggtgcaaacgtttttgtggctggatcgtatgtgtacgataaagtagatcctgctgcaaaaatcggtattttgaaagatttgattaaataatgcagattaatatcttagccggtgggccaacggaattatggcccaaaaatttatttcaggaacaagggatgtggattggcgctgatagaggtgcttggtatctataccaaaaaaatataccaatgatcatggcggttggtgattttgattctctaacagattttgaattaaccacaattcaaaatcatttagccgcgcaaaaaattattcatgtcaaggccgaaaaagatgaaacggacacagaattggccttgatgtacgctcaagaaaaagatcccgatattattaaagtatttggtgctactggtgcacgaattgatcacatgttgagtaatttgtggttaatggctgatgaaaagtttgaaagtattgttgaaaaaacgaattttattgataatgcaaacatcgtgagctatgttacacctggcttaagtgagattgcaaagtatcctaactcaaagtatttaggatttatgccgctcaatgatgttgagaacttcaaaataatagatgccaagtacccattgacactaacaaaaaataagtataaaatgtggtcatcgaatgaatttatatcaaattcagttcacgtgtcctttgatacaggaatcataatgattacgcagtctgtagatggagaaaaacaacatggcagttaaaacagtagaagatgcaacttttaatcaagaaacaaacacgggcgttagcataacagatttttgggcaacttggtgtggtccatgtcgcatgcaatcacctgttctggatgtgctatctgatgaagtcggcgatgtgaagtttgttaaaatggatgtggatgctaaccctgaaactcctgctgcattcggtattcgtgctattccaacgcttttgattaaaaaagatggagaagttgtggaacgcttaacgggattccataataaagaacaattagcaaagattttagctaaatatacaaattaacttgtcaaagggttgaatttctggtaaaatttaatattgttgtagaaagagcttttaaaaaataaacagctcgaagaaggagggttaaacatggcaaaagatgctattactggtgcgcgtacacgctttggtaaccaacgttcacacgcgttgaactcaagtcgtcgtagctggaagccaaacttgcaaaaagttacggttaaaattaatggtgctgcaccaaagaaagtttacttgacagcacgtactttgaaggctggattgaagaacggttctatcgaacgcgtttaagctagtatttcgttagcttgctgacgtcgtaagaccaccatggggtggtcttttttattaatagatagaacacctctcaatgcaacttaatttatgtatggtaaaatatacttagtaaactctttgtgaggaggaaatgcatttattgttatactttagggtgttgataaaagacatctcaatataacgataaatgttcttaaattttatggcaattataattaaaacaaataatggcgatattagccttgaaaatgatgttattgctacaattgttggtggatctgcaattgaaaatcctggtgttgttgggatggcatctaaagcaacttttcgcgatggcgttaatcagattctgaatcgggaaaactatgctaaaggcgttgtagttcatcaaaaagatagtggtgttgcagttgatgtctacttagttgcacagtacggtactaaattgtccgagatttcaaaatcagttcaaggtaaagtaaagtataatcttgacgcatttttgggtattcatgtttctgaggttaacgtgattgttcagggtgttcgcgtcagtgactaggagagattatgtcagttaattcactaacaaagattaccaatgttgaatttggtaagatgattaatgctgcagcggctgtacttgctgctaatgcagataaaattaataaattaaacgtatttccggttcctgatggcgatacaggaacgaacatgagcctttcaatggcgagtggtgcgcagtatgagcgtgactcactagaaacagaaattggtgccttggccaaagctacttccaagggtttactgatgggagcacgtggtaactcaggcgtgatattatcacaaatttttcgtggcttttccaatagtatggctggaaaagaaacactatcggcacgtgatctagctgatgcattaatgagtggtgcacaagtggcatataagtcagtgatgaaacctactgaaggaacaatcttgacggttattcgtgaggcggcagctaaagcaaacaaggtggctgaacaaacagacgacattgttgaactgatggctgctgttcaggaagcagcacaagtagctctggattcaacgcctgaattgttaccagtcttaaaagaagtgggtgttgttgattctggcggacaaggacttgttttcgtattgcaagctttctatcaagtgatcagtggtgattttaatgaagaagatattaaagcacctgataatgctgagcttgatcaaatggtcaaggaacttcatgcgggagcgcaagctagtagcagtttagatccagcagatattaaatatggttactgtactgaaattatggttcagattggtaaaggcacaacatatgatcatgattttgattaccaaaagttttacgattatttagcagaattaggtgactctttattagttatcaacgatgatgaaattgttaaagtacacgtgcatactgagaatcctggtaaggtaatcagttggggaacacattttggttcactagttaaagttaaagtcgacaatatgcgcgatcaacagcaaacagttattgatgcacaacgtgcagaagaagcacgtgttgaaaaaatagctgcaatgcaggtcccagtatctgacacagcagtaattgccattgctgctggggatggtattgctgaacttttcaaaagtttaggcgttcatactgtgatttctggtggacagacaatgaatccatcaactgctgatattgttaaggttattgaagatagtggcgcaaaaagggctattattttaccgaacaacagtaatattttcatggcagcagaacaggcagttacattagcggaaattccagtagaagttgttaaaacacgtacaattcaacaagggttaacagcgatgatgggctataaccctgatgctgatttggaacaaaatgctgcagaaatgtcagaaatgatggctgatgtaaagtcggcgcaagtcacacaggcagttcgcgaaactaaatttaatggccatgaaattcatcatggtgattggatggggattatcgatggtgacattgaagtcgtagctcacaatgttgaatcagctgcgcaagaagctattcaaaaaatgattgatgatgattctgaaattgtgacaattatttttggtgagggaacaaaagctaaagttgcacaaaagttaaaagcatttgtggaagaattagatgacggtctagaagtcgaagttcacgatggtggacaaccattgtatccattcttcatatcagttgaataataaaaaagacgtaaattcagtactacactgaatttacgtcttttttattatagccagcctaatgcgctaatagctgcgtatattactgatccagccattaagataaccataaaccatgacataattaacgtcattttttcgagacgtgtccgtggttttttatcaatttttggcaccttgtgctggtttaactttgattctatttcggcttgtaattttgtgttaaccggtcgatggttttgttcgtcagtcattgatatcacctctaatatattactttctagtctaacatatcttctaaaataattgaaatttctacgcgaattcgttaaagttagatacgaggtaattaacatgcaatggtggatttggccactcggtggttttattttttggacagttgtcattatatttaagaaatggacagctttaaaacaagcatctattaaaacattagacattattacgattcctaactggattgtattgcaccaaacaatgggttatctatttggtattagctttgttccttggtttttacttgtatggttggtcgttgggatctttttagcttggtttttattgcaaaataactggcgatggcaaacattttggcgaaggtactggcaatggagtggtttattggccgcaataattgtcattttgataacaattattgggttattcctccactaaaccccacatttttgaagcgcagttatccttgataactgcgctttttgtgtgctgaaaatttactagtttgtgacaaaacaataatttgggtggagtgaagtggggaaatgtggtaaattaatagtatagaaattttaatggaggtggctctatgttcatgggtgaatattcacatacgcttgatacaaagagtcgcttaattattccggcaaaatttcgtaatcaactcggtgatcaattcattattacaaaatggatggagaaatcacttcgcgctatgccgatggcagtttgggaaaaattgcaagagcagttaaatcaattaccattaggcaagaaagatgcacgtgcttttagacgttttgttatggctggtgcattagaagccgagtttgataagcagggacgaattgttgttcctaataatttaagagaatacgcgtcactagaaaaaagtgttgtagttaccggtgttggtgattcatttgaaatatggagtgcagagaattggtcagcatatacgactgaaactgcggatgattttgataacattgctgaaggtttggtagacttcgacctttaaacgaattaataatacaagttttaagaaagagggctgctatgccatttgaacatgtaacagtactcttacatgaggctattgctctattagatattaaaccagaaggaacttatgtcgatgctacattaggtggcggtggacacactggagaaattttaaagcaactcacaaccggtacactttatagttttgaccaagatgatacagctatccaatataacgctgaacaatacgcagatgaaatcgctgctggtaaattagttataattcataaaaattttcggacattaacctccgcattagcggattatggtgtgacagcagttgatggtattgtttacgatttgggtgttagttctgtgcaatttgatgatggtcagcgagggttcagttataaatatgatgctgaacttgatatgcgcatggatcaacgccaagcattaacagctaaaacaattgttaatgagtggccgtttaatgaattgatgcgtgttttgagccgttatggagaagatcgcttccctaagcaaattgctcgaaagattgagcagcaccgtgaaaacgcaccaattaatacgacttttgaattggtagacatcattaaagaagcaattccagcacccgcccgtcgaaagggtggacatcctgcaaaacgctcatttcaagcatttcgtattgctgtcaatgacgaattaggtgccttagaagattcattaactcaagcacttgagttattagcaactgacggcaaaattagtgtgattacttttcagtcattagaagatcgcttagtaaaacaaatgtttcgtgaaaaatcttcggcaccagaattacctgctggtttgccagtgctaccggggcaatttgaagctgattatgagctattaacgcgcaaaccaatttcaccaagcacagaagagatggctatcaatcaccgtgcagagtcggcgaaactacgtggcataagaagaaaatagactagatgctgtggtcttacataagatcagcaatgataaataaattggagaatattacatggcacaaaatgcatatcaatatacacctttagcacagcaagcacctttaacagcatctcagccgcgtactcatagtcgtactaaatataaagcagccgcttggacaaaaaaagagcgaataatggtagctattgttgccactgttgttttggcattgatggttggcgttgtttatacaagcatgcaaacgaccaaaacaacagccagtgtaaacgcagttcaaaccaaaattgatgaaactaagcaaaataatgacgatttacgtacacaggtgcaaacagccatgagtaaaaaaaatctagataaggttgcaaaaaaatatggcatgacactgtctgacaacagtgtgcgcaatattaatcaataattatgaaaaacaaagtgagacggataccacacaaaaaaatcacgaaaaacgccaagacctttggcgttctgctgcttatcgcaacgaccatcgtgattttaggacttggtgtgcgtctttttattatcgcgggtaataaatcggtagatggtcataatcttacaaaagccacacgtgaggcctttatgggaaaacaaaatattattgcctctcgtggcaaaatatttgattcggacgggcaggtgttggcagaaaataccacagtctataatatgtacgcaatattgaataaaaatcagaaagatactgatggtaagccattgtacgtaacggacaaagctaaagtcgctcgtgagttaagcaaggtaatcaatctaaaagaaaaagaaatctataaacgcttgtccagtaaacaatttcaaattgagtttggtaccgcgggtaaaaacttgacgatttcgcaacataataaaattgagaaaatgaagctttcaggtatctcatttacctcacatcaggctcgaacatatcctaatgatcagatggcttcgcatctgattggaaatgtgaacatggttgaaggtagtagtggtcagtcaactatatctggcataatgggtattgaagcatcagaaaacaaattgctatcaggtaaaaacggtatcaagagttatcaggggcaaaaaactgatagcagtaaaagtgttaaaaatggagatgacgtttatctcacgttagattcttcgctacagacaacgttggaaacacgaatggatacatttgtgaaagccactaaaccaacagcagcagttgctgtgttaatggaagctaaaacaggtcgtattgtcgcagcaacgcaacgacctaattttaatcctaatgataaatcagatactccaacagtttggtccaatttgttagatcaaggagcctttgagccaggatctaccatgaaaggcataacattagctgcagctattgatactggtaagtggcagcctaacgcaaccttccagtcaggaacttatctgattgacggaaaggaagtgacagattcttttggtgatgatcaaggacaaatgacatatcgagagggcttctggcgttcatcgaacgtcgcatttgcaaaaacagagcaaaaaattggtgcacagacgtggaaaaattatttagaaaaattcaagtttttgcagtcaacccagtcagggctaaatggcgaagaagcagggtcaatctcgttttcatatgcgattgatcaagcaaacacagcgtttggtcaagcaatccgtgttacacccttgcaaatgatacaagcttattcagcaattgccaataatggtaaagaaattagaccgtactttattgataaaattgtcaattcgtctactggagaaatagttaaacaaggcaaaacaacgacagttggacatcccatcaaagctagtacggcaaagcaagtcagaaaatatatgatagatgttgttaataagtcggatggaactgctaaggaatttgatcttagtgattacggttatcagattgctgctaaaacaggtacagctcaaatcagtgagaatggtcaatattcacagacttataaagatgctatccattcggtgatggttctagcgccggaaaaaaatccaaaatatatattctacatggctgtcaagcaaccctcaaaattgcctgacggtgatattcaaccaacaatgagtaaactatttaagcctttaatgctccaggctttaaatgatagtgatagtgcggtaaaatcaaagacaactaaacaaacagtacctaatgtagttgggcaatctatttcaagtgcaaaatctacaatgacaaaggctggatttagagttgcagttgtgggatcaaaaggtaaaattactagtcagtcattgttagctaatcaaaagtcattgacaaaccaattagtaattttgactgcaaaaggaaacacatatatgccaaatatgattggttggagtttagttgatgcgcaaacatttgctaataaaataggcttcaaactaacgtggaaaggttctggatttatttcgggccaaagtatagctgaaaaccaacttattgtaaaaagtagtgttgtgtcaattgctttaaaagagaaggagtaatgggagaaaatgacagagtatttttgggcattcacccgtgcgtttattgttactgtaatattcatgcctacggtgatcaaatttttaaaacaatctaaagaacaggccgtaattcggaaacttgggcctgaccatcaatctaaagcaggtacaccaagtatgggtggggcattgtttatcgcagctgcatcgctgagtgcactgattggtagtgtcgcttattcgggtaaaattggatttgtaatggtacttatacccatcttggcagttgttgcttacgcaattattggtggcattgatgatgcgttgaaaatgattcatcatgcggatgatggtttccgcttcataccaaaacttttggcgcaaacgttatgtgcggttgtcatcatgattattatgtggattatgcaaataccactcatattaaatataccgtttattggtgtttttaatttaggaatcttttacttcattttcctgtggttttggcttgtgggttggtcaaatgcgactaacttaacagatggcttagatggtctactaacggggacaagtcttattgtctatctcgtatatacgtggattgctttaggagttcataaccatataattgtgatttttaacgcctcaattatcggtgcgttggttggctttttgttatttaacaaaccaaaagcaaaaatttttatgggcgataccggatctttagctttgggtgctgggctggcaatcgaatcaattgtacttggcattcctttttcacttttatggtttgggttgatttttgttatcgagaccctatcagtagttattcaaacaattggctatcatttctggaaaaagcgaatttttcccatggcgccaatacatcactcatttgaaaagtttggctggaatgaatggcaaattgatgccttgttctggattgtaactgcaatcataggagttattggtattttgtatatgagttaaagcggacattagccgcgtacatataatagaaatcaggttagttatgcgagcaacagattttaaaaacaaaaaagtaatggtatttggttgggcgcgctcaggaaaagcagcagcacaactattaacaaaattaggtagcaaagttacagtggtcaatggcggcgaatttgatgcgcaagatgctacttatcgatcgttattggctgctgatgtaacattgattggcatggacaatgccgaaacgcttgatagcacatatgattacctgattaaaaatcctggtattaattatgaccatcctttagtgcaaaaagctgaaaaacttaatattcctatattgacagaagttgagattgccttgagcactttcaatggtcgcttgatagcagtaactggctcgaacggaaaaacaacaactacatcattaattcgtgatatgttgaaggctgacggccaaaatgtaataactgcgggaaatatcggtgttccagttagtgaagtggtttttgatttaactcgagaagatactttattattggagttatctagcttccaattattaggactacctgatatccaaccagacatcgcgttggttactaatattttttcaaatcatttagattaccataaaacgcgcgccaactatgttgctgctaaattccgtattacgcgtcatcaaaatgctaatcaatacttggttttaaatgctgatgggcaagatacagaaaagtttaaaaatgaaactgaggctcaagttttagaattttctagaacaaaccagcattttccagttgcattttcgaatggtaatttgacattaacagatgaaattgtgatgcctactaaggatattaagttagtaggaccacataatcaggaaaatattttagctgctgtaacagtagctaatttagccggtgtgtctaaaccagctattcgagaagttttaaaaacgtttagtggtgtagcacatcgactgcaatatctgttcacagccggtgatgttaaatactataacgattctaaagcaacagatattgaagccactcaaaccgctttggatagttttgattgtccaacgatatggattggaggcggtttagagcgtggcgatgatttgaaacgtttgctaccaaatctaaaaaatgtgaaggcagttattgctgttggagaaacgcaacaaaaaattgtaacacttgcacgtgaggctggaaaaccagtgattgctgtgactgatgtcgaacatgctgcgccagtagctgttcaattagcttcaccaggagatgtagtgttgctttctccggcacaggcaagttgggatcaatatagtagctttgaagagcgcggtgataattttgttgcatcactgaaagaaacattgaattcatgagaggactaaaatgaaaataattctatcgggtggtggtactggtggtcacatttacccagcattggcactagctgaagtcattcgtaaacatgagccggatacggaatttttgtatgttggttcagaacgtggtgtggaatcaaacattgtgccggccacaggcatgtcttttgaaaaattaactgttcaaggctttaaaagatctttttcattagaaaatatcaagacagtatcattattcttaaaagcggttaaagaggctaaaaagattattaaggattttgatcctgatgttgtagttggaacaggtggatatgtcagtggcgctgttgtctatgctgcccaaaggctgcacatcccaactgttatacatgagcaaaattcagtggcaggcgttacaaataagtttttgtcacgtggtgcaactaagataggtgtcgcttttgatgctgcgctgtcacaatttcctaaagacaaagtatttgttgtaggaaacccgcgggcccaacaggtggcatctattaagtctaatttttcatggcaacaaattggattgagcgatgaaaagccatcattattgatatttggaggctctcaaggggcaccgccaatcaatttagctgtcattgatgctatgcaagagtttaataaaagaaattatcaagtcgttattgtgactggtccaaagcgatatgaaaatgttttagatcggctgactacacagccagcagataatgttcgaattttaccgtacattgaaaacatgccagaggtattggcaaaaacgtcggctattgtatctcgagctggtgcaacgtctattgctgaaatcacggcactgggcattccatcaattctagtgccaagcccctatgttactggtgaccatcaaacaaaaaatgcacaaagcctagttgatgcaggcgctgcattgatgattactgaaccagctttgtcagggaaagcattattgctagcagcggattcgctgttattaaatgaatctgttagcaaaacaatgacagaacaagctaaaaatgttggcatcagagatgctggagatcgtttatacgcgttaatattggatgcaattggtgaataatggagaaaattaaatcacaatttatgaagcgacgaccgttacaactttggattagtttgacggcttttgttgttttaattgtcggtttaattttgagtttacaaccatggcgtacgattagttcagttaacattgattcgaatatgttaaccaaacaacaagttcaaaaatatgttggccttaacgataaaacaccacgctggcgtgttcttggacaaacgactttcatcgcgcatcaattaataaaaaaagatgccaaagtttattctgctgatattgatttggacagtaatgtcgtttcaatcaaagttgttgaaaatattagtgcaggatttgtgaaaaaagatggtcaatggtatgcacttaaccgtcaagggaaatcaaaaaaagttgataatcctaacggaaatgcaccaatttatagtaacttcaaaaataacgcgcaactgactaacacggctaaaactttctcacagtttgaattatcattaaggcagaacataagtcaaatcatatattcaccaaccaaggacaacaataatcgtttgaagattattatgacggatgggaatacagttttggctacgctgaagacatttgggaaaaaaatgatttattatcctggtattgcagctcaaatgcaaaccaagggaataattgatttacaatatggtgcatattcctacggatatggttctaaatagaacggcaaatgagtggtaaaacacctcatttgtatggtaccattagtactaggtatattttaaaaaaataatttataaaggggcacgacgcatgaataattcaggcgtgacggttggattagacatcggaactacttcaatcaaggttgtcattacacaaatgactggtaatcagttcaatgtaattggtgcaggaaatgccccatctcggggcttgagacgtggtgtcatcgttgacattgatgcgactgcaagtgcaattcgtgaagcgattgaccaagcacaagaaaaagcaaatattcaaatcagtgaagtcgtagctggtgttccagctaatcaaattaaaattattaatgtcgacggtttagtgtcgattgctaatcagaataaaagaattacatatcaagatgtacaaaatgttgcaacacaggccttgtcgcgtggattgccagctgaccatgatgtaatagaattggtcgctgaggaatttgtagttgatggttttgatggcatcaaagatccacatgaaatgattggtgttcggttagagatgcatggcattgcttatgttgggccggaaaaagttttagataacacacggatggctattcaaaaagcaggattaactttacgagaatttgtattagcaccattggccatgggatctatcattttaaatgatgggcagcaagattttggaactgttcttatagatcttggcggcggtcaaactagtacttcagttatccatgatcgaaaactcaaattcaccttcgtcgatatagaaggtggagataatgttactaaagatatatcaactgtgttagggacatcatatattaacgctgagaaaatcaagcgagactatggatatgcagatccttcgcagactgtgtcatctaacgaatttccagtagaggttatcggcgaagaatttactaagcaatttgacgaacagtatctttcagagattatcgctgcacgtttagaacagatgtatacgcgactatttgagcaattaaagcaaattggtgcgttgaatctaccaggtggttttgttctaactggtggcaacgctgccttaccgaaaatggtagactttgcaaagcgagttttgggtgataatgtccgcttgtttgtaccagatcaaattggtttgcggcatccagcctattcgcgttcgctatcctatgcgatgtttgcttctcgtgaaagtatgacacaacaggtgattaagcaaactattatgcaacgtcatgcagttgaacaacaaacttccatgttaccagaagagtatggggatgaagttgtgcaacaacctgtagaaagttttcagtatgatggtgaaattgtaaatgacccgcaacaaggctggtttggcaaaatgcgtcaaaaactcagcaatttatttaatgaagaataatcgaacatttaaggagacgactcatggatttttcaattgatgacgcgcaacaagcaggcgcaatcattaaggttatcggtgttggaggcggtggttccaatgctgttaatcatatgatagaagaaggtgttagcggtgtcgaatttatcgttgccaacactgatgtacaagcactagacaaatcaaaagcagacacaaaaattcaaattggtcctaaattgaccggtggattaggtgccggttctaatcctgaaagaggaaccaaagccgctgaagaatcatcagaggcaattgcttctgccatgacaggggctgatatggtagttattacagctggaatgggtggcggaactggtaatggcgctgctccagttgtagcacgtattgccaaggagcaaggcgctctaaccgttgctgtggttactcgtccatttaagtgggaaggtccaaagcgtggtcgttatgctgccgaaggtcttcaagcactctcagaatctgtcgattctttgattgttattacaaacgaacgtttgaaagatcgtattgatttgcgcacgccattgtcagaagcttttaaggtagttgatgaagtcgtggcacaaggtgttcgtggtatttcagaattgattacaaacccaggctttattaacttggattttgctgacgttaaaacggttatgcaagatgccggacctgctttgatgggtgttggacaagccagcggtgaaacgcgtgcagctgatgcaactaagcaagctatttcttctccattgttggaagttgatatggcaggagctgaagatgttttgttaaacatcacaggtggtttggacatgtcattgtttgaggcgcaaacagcctcagaagtgattagccaagaagccggtcacgatgtcaatgttattttcggtacttcaattgatgaaaacctggaagattcaattcgagttacagtgattgctactggtttacaaaatgtgactgaaaaacctaaaatgactgaaaacactgctgcctcagctgcaaatgtttttggttctaacgttaatacaagtagcacaacaaatacaaatgaagcgccaataaacaattctgtatttgaaaagccagcaccttcaaatgctgcgcctaagcctacaatggcacaaaatgatccatttgcagactggaacattacgaatgatacaaaagatgtattctctgaggaaaaacgttttgacgatgttcaaaagcaatcttttgatgtgtttaatacgccaacttcaagtgcatctgttgatttgtcaaatgatgatgataatgatcagccaccatttttcaagaagcgttaaggagaacttatggcattaggtgatacaattaagcgtcttttcagcaatgaagaagacgactattacgaagaagatgggtatgaacaaagtcagcagcaagagcagcagacaacacaacaaacttcttcacaaccacgatttgttagacaaactacccagtcacaaactcctgcaggattgaacagcgctaacagtaaaattgctttatttgagcctaaagtttattcagattctcgttcaattgcgtcacagatacttggcggtgaggctgcaatcgttaattttactcaaattgatgaagctcaagccaagcgcattttagatttcctaggcggtacaatatacgctgttaatggggaaattgaacgcatcggacaatcaatttttttggtaacgccgaatacatttgagatttctggcacattgacggataaccttgaaccaaacagccggtactaatacacatgataatagaaattattaaatgggtttttaacctgattcaatattatgaatatgccattgtcgtttatatcttaatgtcttggcttcctggcgcacgtgaatctggcttggggcggttccttggaaaaattgttgaaccttacttaagcatgtttcgttttattccgcctatagcaatgattgatttttcaccaattgtcgccataattgctttgaattttgctcgtagtggtttattacacttggttaatttgtttctatgacaaacaagctatcaacaattagtcaacattttcgtttaaatgaacaaccatttgtaaagcaagttgataattggattcaacaatctagaaatgaatatcgtagtattttaacacgatttctcaatccacgggaacagtacattttaaatgttttagtgaatcatgctgctgatttagctgtttactttaatggtggtgttcaaggtgcggaaagccagcgtgctattcttatacccaaggaatatcctcaagatgatttggaatttgagatatcattgcttgaaataaaatatcctactaaatttgatgacctgcatcactcaactattttaggctcaatgatgtacagtggaattagtagaaatgttatcggtgatattttatatgatcagacacacagccgatggcaaatcatcattgattcaaagatgcaacattacatgcaacagatggttaccaaaattggtcatgttcaagtgtctctaatagaatgtgatcttaataacgtactaccccatataaatgactgggaagaaaatttcttgttgttatcttctttacgacttgatacggtaatttcagctggatttgacctatcgcgttctggtgctaaaaagctaattgaagaaaatcaagtgcgcgtgaattggagcgaaatagctaaaccggatgtagaattagcaatcggtgatgttatttcagtcagaaagcatggtcgagttcagattaaattgcttgacggaataagtaaaaaaggcaagattaaatccattgtcaatattatccggagatagtgagcaagtatgaaataactgtagttgtgaacgcacaaaacatattaaaggagaaaaattatggcattaacacctgatgaaattttgaatcatgaatttacaaaaaaaggcagcaaagcttacattgcaacagatgtcgacgcatttctggaccagattaacggtgattatgaagccctgattgcagaacgtgatgaattaaagcatcaaaatgaactagctcaagtaaagattgaagagctagaatcaaaacgtgatcaagtgaatcaatcaatctttgttgcccaagaagcagctgatcgcttgaagcaagatgctgatgtcgaagtgaaaaagcagttgactcatgcacaagaatcagcgacgaaaattattaatgatgctcgagcaaaggcagatgctgatgctgttcgtttagcccaagaaaatgctgatctaacgaacgagcaaaatcaattacgtactgaagttgaagattttaaaaattcattcttgcaattattggaatctcagcgtaaactattagaaagcgatgagttagcagaagcagttcatcgtttaccaatggggcaagtaactgctcatcgtattggcgaaatcgctaaggctgagccagtagctattcctgaacctgatgaagaacagaaggatccagagtcaagcgaggagcaaggccctgtggtagtgtttccgggatcagaacaaaacaaagacgataaataattataaaaagcgtaacacagcaaggttggcattcatacgtgcagcgagtcatggtggttagagatgatcgtccctgatgttgaccagatcagttactattttgtttagctgaatatcaatatttagtaagctaagccggtgaggatcgttaaaccccagttgagggcagcatttttatgctgctaaacgttgggtggtaccacgctattgcgtccctatgctttcgagcataggggctttttatatttattatggtttaaataaatttgtttaaaatggctaaaaaatgataaaaaggagaatttatcaatgaaatataaagatacattaaatcttggaaaaacaggatttccaatgcgtggttcgctacctaaaactgaacctgagcgtcaagcaaaatggtatgcacaggatttataccaaaaaagattgtcccaaaatcaattgaaaccacattttaatttgcacgatgggccaccatatgcgaacggaaatattcacattggtcatgctttgaataagattactaaagatattattgttcgctataagaatatggcaggtttctatgcaccgtatgttccaggctgggatacacatggtctaccaattgagcaacaattgacaaagctggggcacgatcgcaaaagtatgccaaagcatgagtggcgtaatttggcgaaagattttgctctgaagcaggttgatacacaacgtgctgactttaagcgactcggtgtgttaggtgattgggataatccatacataactttacaacctgaatttgaatcagcacaagttcgagttttcggtaccatggtttccaaaggatatatctttaaaggcgcaaagccagtttattggtcatggtcttctgaatctgcattggctgaagctgaaattgaatatcatgatattgattcaacgtctttgttttatgcaaacaaagttaaagatggtcatggtctcttggatgaggatacgtactttgtagtttggacgacgacaccctttacagtgacggcttctcgtggaattaccttaggtcctgattttgaatattcggtggtgaaaccagttggggaagaccgtaaattcgttgtagccacagacttacttgaaacagtggcgcctaagtttggctgggaatcatgggaaacggtcgctacttacaagggacaagaacttgataagattactgcataccatccatgggatagtgagcaagaagagctagttatgaatgctgatcacgttaccctagattctggaactggattggtccatactgctcctggttttggtgaagatgattataatgtaggtaaaaaatatggtttgcctgctgatgtcactgttgatgccaaaggatttatgacggctaatgctggtcctgattttgaaggcaagttttacgatgatgttgttggtacggtgattaataagttaaccgatgcgcgcttgttcttggcaaaagagaaaatcacgcattcatatccatttgactggcgtacaaaaaagcctatcatttggcgagccgtgccacaatggtttgcatctgttgaaaaattccgtagtgaaattttatcagaattagataaagttgcttatttcccagaatggggaaaggtgcgtctgcacaatatgattcgtgatcgtggtgattgggtcatctcacgccaacgtgtttggggtgtgccattaccaatcttttatgcagaagatgggacagctatcttagatgaaactgtcattagccatgttgccgatttatttgcagaacatggttccaattattggtttgaacatgaagctaaggatttgttgcctgaaggctatactaatgaacattctccaaatggtgaatttaccaaggaagaagacatcatggatgtgtggtttgattctggttcttcatggaatggcgtattgaatacacgtccacaattggactatccagctgatatgtatttggaaggatctgatcaatatcgtggttggtttaattcttcattaatcacttcagttgctgtcaatggtgtagcaccatacaaggctatcttgtcacaaggatttacccttgatggtaaaggtaacaagatgtcaaagtcactgggtaatacgatttctcctattgaagtggccaacaagcttggtgttgaaattttacgtttgtggacaatttctgttgatacatcgcaagacatgcctgtatcaaatgaaattttgaaacaagtttcagaaaattatcgtaagttgcgtaatacattgcgtttcttgatggccaatacagctgattttgagccaacaaaagatgcaattgcttacagtgatttatctgcacatgatcagtatttctacgctttagaaaatgagttcgttgcagatattcgtaaagactatgataattatcaattaaatgatattttcaagcgtgttattaattttgtcaacgttgacttatcagccttttatttggatattgctaaagacgtcgtctatgttgaagccccaacaagtcatgcccgacgctctatgcaaaccgtattttataaaacgttaactgatcttgtacgattactattgccagtattaccacatactgctgaagaagtatgggagtatttgccacatgaaacagctgaatttgcttacttgacagatatgcctggggtagaggatttgggtgacacgacagcactgtttgatcactgggcagtgtttatgaagttacgcgatgcagttaacaaaatattagaagaagcgcgtgaagcagatttgattggtaaaaatgctgaagcagctttgacaatgtatttgacgactgagcaacaaaactggttagcagaattgcatgccgatgttcgtttgcttctaatggtatcgcaattgcatgttcaagatgttcaagacgctgagaatgctaaagattatgatggttggcagttggctgttgctcatgcaacaggcggtgtttctccacgagatcgtatgttccatgaggacttaggtgctgattcagctttcccagaattatcaaaacatgaagctgaaatcatacgcgagttttatccagaagctgtaacagagggcttggagtaaattaaaaacattacacttttattatgtgtaatgtttttttgtttggcaattatttgtttagtgaaggtgagtttttagtaattagtttgttatttagttgtaattttgataaaataatgggtaaagtgtttataggagtagggcttatgggcgaaaatgatcaacttaaaatttggcaagatgaattagtaaaaattattaacgatttaaacacaccacacacacttggtggcattacgaacccagcaaatcgtaaacatgattcaatgttggcgcgtcgagcactagataatttaattattttgagtgaagaaattaatacggcgcgtcatagcaatgatgaatagtaactctgaaacaatgcccttctgattttaaatgtatatgtcaaggtatgctacttgacatatatattggtatatggcataattatatagtaaattaaaagtgtaaaaagcacaaaagaaatttggaggactaccacaatggcagttaaaattcgtttgaagcgcatgggtgcaaagaagcgtccattctaccgtgtcgttattgctgattcacgttcaccacgtgatggccgttttatcgaaacagttggtacatataacccaatctcacaaccagcagaaatcaagttggatgaagaaaagattttgtcatggttgggtaatggtgcacaaccatctgacacagttcgtaacttgttgagcaatgcaggtattttggcaaagtacaacgaatcaaagtcaggcaagaagccagctaagaaagcaacaactaaggaagcttcagctaagaagcctacagataagaatactgttgcagaaatcaaagcatatttggatgcccaaggcactgcatatacttcatctgctaagaaggctgatttattagcacttgtttaatataactgacgaaacagtcgcttctataattggaagcgactgtttttatttatcgaatatcgtgtgtcgataataacatcattaataagggagaattaatatgttactaagttttgtaaatgttacgctggtatttttgattggaacattgcttgttaatatcattgcggtggcgttgaatcgcagagtaaaatggttcattttgagcaccttgattgaatttattttggcctatgttgtgctgtatattcagttgccgccaaagaatatgacaacactgatcaatgtcaatattttatttgcatttgttgcagcaattattaatttaattggctatgctggattagcttcttttgataaaattcgtgattggggaagcaaaaattatgccaaagatgtgagtgaccgtacaaaaacttatttctttcgtcgctatatttttgttgcagtagcaccacttgttttgtggatagcagtaggtgctgtgtcttttgtcacaaagctaaccagtattaacaatgtttatagttcaataccagctaaaactaaagggtcttcggagttgttgacatccgctaaggatatgccaattgcgctggcacctgatactgccaaaaggaaaatgcaacaaaaatttagcgtcattcctaattcaaacatgtatgaattggacgggattactgctcaagtagttaatggtaaatatgtttatgtggctacagtagagtttaatggttttttcaaatggttaaagaataaatcagttccaggatatttcattattagtgcaactgatgttaacgcacaaccaaaatttgttaaggaacgattaaaatacagtccatcggcgtatctcaataatgatgctgctcgtaaaatatatgcgtcagcaccaacttatgctagcatgggcaatatgaatttagaaattgatgagaatggtacaccatattatattcaaacactataccgtgaatatggtgtttcaggacgaatgaagttcaatgaatttaaaacagctgtgttgaatgcgcaaactggtgaagttaaaatttacgcggcgaataaggcaccaaaatttattgatgcacctattacaagttccgtagcaaataaaatgaatgaattttatggtcgatatcaaaagggttggtggaaccaaacatcttttggcgcaaaacgtgatgtgaaaattccaaccgataatggtgtttatgcttcgggtcaaatcacaccattaattgattcaaaggggaacttattgtacttcactgattttacgtctggtaataataatcaggattctgctcttggttattcattaattaatgctcgaacgggtgaattaacttattatcgtgacacccattcaggactaatggactcagatggtgcgatcagcattgcagataaaatatatcccgagaaaaaatgggtagcacaaatgccaattttatataatattgatggcacaccaacatgggttgtttcattattagatagtaagggaatttttaaaaagtacgtatatattaatgctattgataacgacattgtcgtcgatggtgataatgcccaagaggcacttgatgattatcgtaatgatttagcttcaaatagtacaaacaatcactcaacgaacaaaaagtatgataaaaccattagcggtagcgtaacacgtgttgcattaattaatgatggtaaaaatacgattgttaatttcatggtcgaaggacagtccgctgtctttaagattgacgcagataatgcgcctaaggctgtattcttaaaagaaggcgataaagtcagtttcaaagcaaatatgttagatgatgcgaagattgcgacaatcgagaaaataacgattgatgggttaaagtaaatagtcataggaattagaaaagcgtacgaacaatcgtgcgctttttctgttaaaataacattaatagtaaatggaaagaggtgtgacatggcttttttagaagttaattattattcaaaagtgcttggtatggatcgtgtgatgaatgttattctacccgaattatcagatcataacccaacttggacaacagaaactctgaaggatattcctgtattgtaccttctccatggtatgtcaggtgatcatgcaatttggcaacgtcggacatcaattgaacgtttagtaaggcaaacacctgtggcaattgtaatgccgtctactgacttagcttggtatactaacacaacctatggattggactattttgatgcattggcacgtgagctacctgaaaaagtagctagcttatttccacaaatatcaactaaaagagaaaaaaatttcgtagccggactgtcaatgggtggttacggtgcgtttaagttggccttgggaacaagtcaattcagttatgccgcctctctttccggagcattagtaggcaatccgagacaagaagactttttaaatatggaaaagctttcatattggcaaggaatttttggcgattttgatgattttgctggttctaaaaatgatattttagctctcgccaagacgtgtcacaagcgaccaaaactatatgcatggataggagaacaagattttttgaagcccattaatgatgttgctatatcaactttgcagcaattgaattatgatattacatacgaaacagcacctggcacacacgaatggtattattggaacaaacaaattgaacgcgtgttagaatggctaccaattaactatgttcaggaagagagattgagttaatgtcactcaatgttgtaatgggtaatggtcaacatgacttaagatccgaaatgttgacaatgattcaacagcaatttcgtcaaaataagttgctgacagttttttatattgtccctaatcatgtgaaattcgatagtgaggtcaatgtactgcagcgcttttcaataatgaatggtaacgacgacagtgagttgtatgcgcaaagtcgtctgcaagtctactcattaacccgtttagcttgggcattaatgaaaaacacaccagatcggcaaccagatatcgtcgaaccgacgggattatttatgattgtttcaaatattttacgtgaacaatcagataatttaccagtgttctcacggatgcaaacaaaaagtggctttgtgtctgcattggttgcccagttggtcgagttacgcgctagtaatgtcacgccagaaaatttattagaagttcttgagaaatctgcagataatatatttctgagacaaacacttaatgccaagttacatgatttggcgatcgtggctgatgattttaatgctcgcatgggtgagaatcaaattacaggacaggaaacattgattgcctttgcaaaacagttggctgatcttaaactatctaacgttgcattttattttgatgggtttaatgggtttaccagtgcagaaatgatggtagtcaatcaattaattactacttacccagtgacaatgggtatcctcggtgaccctgaaaaaatgggtcaacaacgagaaggtgatgtgttctttaaaccaatgacaacggttgaacaattatccataacagcacgtactgcacagcaagaagtggctattactgctgctacaaaaatgagaccactatcaaggaccgcgcaacaggttttaggcgcttgggcgtgcctaggtgagtaccgcaattttactggctcacgagatgaggtacacttgaatgtttttgcggccgaaaatccaattactgaaattaaagaagtagcacgacgtattaggcgttcactagttgatgatccaacattacatttacgtgatattattattttgtcacgagatttaacaccgtatcaagcacatatagaagcagtcatgtcgcaatttgaattaccatattttttggatatggatgtgaatatgatgaatcatcccttggtagagctaatattgaacttgttagcacctaataaatttcagtatcagacgatgttggcgattttaaagacaggattgttacgaccaacttttgaaaataaaattgtttcacacgacgagttttttgatatcgtttcgcacatggataactatttatatgcttatcgaccatatgaatcaaggtggcgtgatttttcacgaccatttaaactttttcaagtgacgcgagatgacgatgatacagaaatttcagaagacgaaaaagttaacaaccgcttggaatatctacgccactttattgtcgaagcttttgatgagttggatgacggatttgcaatggctaaaaatttgcgtcagtcggtgacgcatctcgtgttatggttacaaaaatatcatgtaaccgatgctcttttagaacagcgtgatgattttattgcacaaggaaatttatctcgttcacagcagagtgaagaagtttggcaaatgctgacaaaaactttagacgagatggttgaaattgatggcgagcgtagtgtatcactcactgatatagtgaccacgttgcaagctggtttgtctggcgcaaaattttctggtataccgaataatttggaccaattaatgatttcagaagcaggaattgttcaaaatacgcagtataaacaactttattttattggtggcacacgtcagaatttgccagcacaagtaaaaaatgcagcgctgatcaatgatgctgagcgatcaattgtgcaacctgctttgcagtcaggaactaatccgcgttatttgcaaaacactgcacaacagcagatggcagaagaaaaccttcttttttatggaagtttgatgagctccatcgggtcaataacactttcttacccaattttggaaccaagtggacaactagcagaaatgtcaccgtttttcaaacgattagtagatacatttaatagtgaagtagaggtaatcggtagtataccaagtagcgcggcatcgctattaaagcaatatgttgggacagcaagagcaactttgtctgatttggttaaaattttacctgtttacggccagacagcagcttttaaagccgtccaaaatgttatttccaatacaatgcaagatagacttgaacgtgtgttatcagcaccaaattatcaaaataatactacaaaattaaagccagaatttatctcggctttgtttggtgaacgactaaacgtctctatatcacagttggaaagttattatagtaatccatttgcttattttctccagtacggtttgaagttgcaagagcgcgcaacgaacgaactgaatgtggctcaaactggtacgctttatcatgcggtttttgaaaatgtgctccatgaattaattgtaaaaaataaaagtttacgcgatatcactggggatgaattacgtgctttagtgcgacaacatatgcagagtcaattagcgttaccagcgtttgaaatattaaatgactctggcaaaatgcgggcaactacaaactatttgacacgtgtctgtgaaacgctagtactgaatttacaagctgcggcacgagaaaatacgagcaaaccagaagcagttgagcaactatttggtttttcaaaggagtcattaccaccactttcttttgcacgtatgcaagtgcgtggtaaacttgatcgttttgataagcaagatgtaaatggcgaattcggtacaatcattgattataaatcaaatggcaaaacctttaactggggtcaagcttacgatggtttgcaaatgcaattgttaacttattgggacgctgcccaacaaagcgcagaaaagcttggtgtcgcggctattggaggtgctttttttgccaaaatatctccagaaaaaaccaaaataacggataaaacagatcttaatgcgctatttactggcaaattaataccagaaacttttaagtatcgtggtctttttatttctgagccagcgtatgtttctgcgctgacaactttagaaccacaagaaaaatcagctcactatccagtagtattactgaaaaacggtgcgttaggaaagattggtgtagacgcagttgatccagatgagtttgctttattactacagcgtaatcgtgaaaatattattactgcgggagatctcattttgtctgggtattttccaattatgccagttgaaggtggattgacttattctccttatcttgatattatccgttttgatcgtgctttgggtgatgcttataaagtgcagtcgccagctgataaaaacacaatcattaaattattgaaaggtggtcaagattaatggcaaccaaattcacaaaaaatcagcaacgtgcaattgaagaaaagggtcataatattctagttgctgcatcagccgggtcgggaaagacgactgttttaattgagcgtctcattcaaaaaattttaagtggtgtgagtgtcgaaaaatttttaattgtaactttcacaaacgctgctgcaaaagaaatgcgggaacgtttagaagtcgctattgaaaaacgtttaaaggtagctgatgaaagtcaaaaacgctttttacaagagcaactcttgatattaccagcagcgaacatttcaaccatagatgcgtatgctttacgaattattgaaatgtattaccacgtcattgggttagacccacagtttcgattattgtcagatacggctgaacgtaaattattgcaacaagatgttttagctgatgttttagctgatttttatgatgaaaataacattcatcatgagcagtttttaacattagtaaataattttggtaatccaaatcaagatgaccagttacagaaaatcattttaaggttatcagattttgcagaagcccgcgctgacggaaatgaatggttagagaagctacgtgaaccttatgaagtgacgggggaaccactgacagcaacagcgttatatgtacgcagtattcggccaattatcctagaaattattaaggatctgattaaaaaagttgaagaagtacaacttattattacaggaattgatgaactcaaaaaaacacaagatgcttttcttgagttccaagattatttattattaatccaagacaaagcgatggttggaccttgggatgaacttcgggaagctattttagacacaccaagtggtaagattaattctcaaacaaaagcgatcaaagaagatccggatttgtcagccacgcttgaagtggctcgacagattaaagggcaggttgttggcgtcaaatcgcaaatgaattcattgataacatcttattttgcactcgatgaaaagtcatggcaactagtgcaaaaagaatcttataagctaattgatacgctaattctcgtaacgcaagcattccgagaatcatttagaaggaccaagcgcgaagaaaaattacttgatttccccgatttaggaactttggcgttagcaatactatcagatgatgttaccaaacaaacaatccaagggcaatttgatgaaattttagttgatgaatatcaagacatcaaccaattacaagaaactctgttaactagtgtctcgaacgggcataatatgtatatggttggggatgtgaagcaaagtatttatggctttcgtcaagcagaaccatctctgttcacaaacaagtataaacaatttgcgaaaaaagaaagcgatgatattcgtattgatttagcggataattttagatcgcaaaacaacgtcaccaatattacgaatttgatttttacgcaaataatggatgaaacacttggagatattgcctacgcgggtgaggcaaaactagttccgaaagccgcttatccagatgatgtacctgctgtatttcatatggacattattgtcgaagacgctgaagaagatttggaaaccgatacggaagtatttgagaaaaggcaggcccaatatgctttgctagccgaaagaatactgaagctacgtgaaacttcaatattcgatcgtaaagctgatccagccggtcttcgcccagtgcagtacagtgatattgccattttgacacgagctaagtcgggctatattgaccttgtgtcaaccttacgtgcggcgggaattcccgttcaagttgaaggtgtcggtaattattttcagacgatggaagtgtatctgatgctcgatatattgcgcgtcatagataatccacatcaggatattccattagccgcggtgctacgttccccagtttttaactttgatgagaatgagttggcggcaattcgtattgcagataaaatgcatgattactggacagcgttgcaagcttacgcgcaacaagatcaaaaagcgcaaaatttcctcaatttaattgaaaagtggcatgcaattgcgacacaaaacgatttagtagcattaatctgggctatctatgatgatacggcgtggcttgattacgttgctggtatgccgggaggtgcacaaagacaagcaaatttgcatgcgttatacgaatatgcgcgtacctatcaaaataatacgcatagcggtttgttccgttttattagatatattgaacagttgcagtctggtgacagcgatttaggcgaagcagcacaagaaacggatgctcaagctgtaaggattatgaccatccatgcatcaaaaggattagaatttccaattgtatttttaccagaatttgataaatcatttaatacccaggatttaaagggcggcctattgattcaaaaaaatgaaggtgtagggttagagtatattcaaccagatgctttggttatgatacctacattacaaaagcttgtagtgcagcaggcgttaaagcgacagagttggtctgaagaaatgcgcctcttatacgttgccctgacgagagctgaacagcaattgtatatcgttggttcggttaaagtcaagggagaagcagggaaccaatcattaaaatctttgtggcagcaatccaagaacgccaatgggcagtttttaccagaatttttgcgcttacaagccgattcatatctaaaatggactattatgagtttagctcgtacaaaaaataaagtactagaggattggcttggtgatggtcaattaccaaggttggtgggatctgaaacaccattaacaggaaaggtggctgttacactcacgaatcaaaacgaaattcatgcaccaatagcgagtgctgaagggagtgaattagttgaggatggaacctattcgccgatggattttgatcgagctaaaacaattttgaactatcaatatgctaacttacaagcaacacaaacagcggcgtatcaatctgtgagtgaaatcaaacaaatctttgaggacccggatcttgctcaaatgcagacggccgttattactgaaaatggacagttacaacctgctaatgttttgaaggttgacgagttacctttaccagatttcatgaatgatggttcgcaaaaaccatcaagctctgcggtaggaacggcaacacatttgatcttacagttgattgattttaccaaaattaatacagtacagagcatagaaaaattacgtgacgaattggttgaaaataaaagaattttgcctagcgtggcaccactaattgaaattgatgagattcttgcatttttgcaatccgactttgccaaacaaatcattgctcaccagaagacgttgcacagggaagctacttttgctatgattatgccagccaatgatatttatgacacactagaggattctgcaccagtgttaattcatggtattattgatgggtattttgttgatgaagcatcacgaacagtcacgttgtttgattataaaactgattttgttcggaatattcaaatagatgaagacttggctaaattgcaggcacgatacaagggacagcttcatttgtatcaacaagcacttcaacgggaatatgttggttatcaggttggtgatccacaattaattgctttgaatgtcggtcgagtaattagtgtaaaatagacaataaatattacttattgggttttacacaaaaatgtcatggtgaagtaatgataaaatatgaaacaatctcttttttaaacggtaaactaacattatttaaaaagaatgatcaaattgtgtgcattagtctagctgatgatggtgttagcgaatttttaaatgactttccagaatatgaattagaacagcaagtattgccagaaacaagtctttttcgagcgtatgctgctggtgaaaagattgatttctcgcggattaagattgggtaccttaagtccactgcctttcaaagagaggtatggcaggccctaaatacctgtcatgaattattaacgtacgagcagttcgcaaaaaagattaatcatcccactgctgttcgcgctgtagcgacagcgattggtaaaaatcctattccaattattaatgcctgtcatcatatcttacctaagagtggtggtgcgggtaagtatagatacggtactgacattaaaagaaaattattagtattagaaaacctattagagaagtgagaaacagtgcgtcagtgagattttatgacgcactttttttgtatttccgtttgtaaaacctgatacaatagacttatgactaatacagaaaattattttaaagttggcacaatcgtaaacacacatggtattcgtggtgaagtgaaaatcatggcgattactgattttgctcaagatcgcttcaaaaagggagcagatctatttattgatacaaaacagggacgtatccctgtcaaagtgcagtcatcacgactacataaaaacatgtggttggttttatttgttggcgtaaccaacattaatgaaattgaaaaatataaaggtgatgatgtttatattgaaggtacagctcgtccagaattagaagacgatcagtactattacgatgaaattatcgatagcactgtggttgatttggatggtaacaaaatcggtgttgtcaaggaaattatggaaacaggagcgaatgatgtttggatagttcaacgtgacggtcaatcagatgccttgattcctatgattgatgatgttgttaaatcagttgatgttgacgccaaattaattacaattgacgctttagaagggttattagattaatgagaatagatgttttaagcttatttcccgacatgtttgcaccaatgcgccaatcaattattggcaaagcgattgataaaggggcgttagactttcaagtgactgattttcgagatttcaccgaaaataagcataataacgtagatgattatccatttggtggcggcgctggcatgttattaacaccacaaccaatatttgatgcgatggcctctgttgaaaagcaagctggtggcaaaggacgtgtgatcctgctggatccagcaggtagacagttcaaccacgaagttgcccaagaattagctacttatgaccatttaacttttgttgctggtcattacgaagggtatgatgagcgcattcgagaattagtcgatgatgaaatttcactaggtgactatgttttgacaggtggagaactcggcgcgatggttattatcgatgccacagtacgttttctacccgaaattttaggtaatgcagcaagtgctgagggagattcttttgaagatggtttgttagaatttccgcagtacacacgaccagctgattttcggggacgaatggttccggaagtcttgactagtggtaatcacgccaaaattgctgagtggcgattaaaggagtcattgcgccgtacttatttacgccgacctgatttattagaaaagcggcagttaacgcaacaagagcggaatttgctggataatataaagaatgaagaacagtaaaaagttttgtgagaaaaagtaacagaactagcaaacagatatggaggaaatgcgtttagctatttcaggtattgtgaataaatacctgattactcacgcttctaaaattatgaaaatagcaatagcagggtttggtgctttaggcgctcgagttggtgtgatgttacaacaagctggccatgaagttacaggaattgatggctgggctgcacatattgctgccataagcacagatgggttaacagtgcatcaagatgatggggcaacaaaaaaatattatattcctgttatgacagctaaagaaattgatggtaagtttgaccttattattttgttaacgaagacccctcaattagatatgatgttaacagatatcaagcacattattactaagaataccaagctgttggttctttctaatggtcttggtaatattgaggtcatggaaaagcatgttaatcgcaatcaaattttggctggtgtgactttgtggacatcagaattaattaatcctggtgaaattcgcgtgacgggaactgggtccatcaaattacaggcaatcggtgaggctaacgctaaaccaattgtatcggctctgaataaggctggtctcaatgtgacattatctcaaaatgtcattgaagcaatttggcataaagcgggaattaactctgtccttaacccgttaacagttttgttagatgcaaatattgcagagttcggtatggctggaaatggtatggatttatcactaaatattctggatgaaataaaaaaaattggtgagttagaaggaattaacgttgatgtaaacgcgatcatgaaggatttagccttactcatacgacctgaaaatgctggaaatcattacccatcaatgtatcaagatattaaagctggtaaacatacagaaatcgattttttaaacggttacttcgctaaattaggatctgaacatgatgtagctatgccatttaatgctctggtaacaagattaattcacgctaaagaagatattgagcgaacaaagttagctaaaaaacaggaaacttttgaaatttaatcttaattaaagtaaaatgagtgtaactgcttttacttttaatttgtaaggagaaataacatggcaatagaaactgcaatatttgctggtggctgcttttggtgcatggttcaaccatttgattctttggatggcatagaaaaggttcgttcaggctatactggtggtcatgttgaaaatccaacttatgagcaagtactaacacatactacaggacacacagaagctgttaaaatttggtttgattccgaaaaaataagttatcgtgaactagtcgaaatatattgggaacagactgatccaactgatgcaatgggtcaattccaagaccgcggtgataactaccgtccagtgatttttgtaaatagtcctgaacaacgtgaaattgctgaagaatctagagccgcattagcagcttcaaatcgttttgatgaacccatcgtgacgaaaattgaagacgccaaaccattttatgaagcagaagagtatcaccaggatttttacaagaaggatccagaacgagaagcactagaaatggcacaacgcttgcaatttaaagctgataagtggaattgaatttaaccaatatattttaagataaattcaatttaaatgatatgaaagtgagcggaaacgctcattttttgttataattgactagttatgaacgttattaagaaagcgctcagtaggtaaaatgaatgcaacttgaatttctcgggactggctctggccaaccatctaaatttagaaatgttacaagtattgcgcttcgcctcttagacgaacgcaatgctgtgtggctttttgatgttggtgaagcaacgcaacatcaaattttaaaaaccactttgcgaccacgtaaagttgaaaaaatatttattacacatttgcatggtgatcatatatttggattgccgggattcttaagctcacgttcctttcaaggtgctgataaaaatgagcccttaactatatatgggcctaagggtgttaaagaatttgttcaaacggcactacgaatttccgaaacacgtctatcgtatccaattgagtatgttgacttaactgaaggtgtcatctttgaagatcatacttttcaagttgttgccgcaccaatgcgtcatcgtattgagacctggggatttcgtgtgatagagaaagatcatccaggcgaactattagttgataaactaaagcaggaaaatattccttctggaccagtatatggacaactcaaagcaggaaaaacagttacactaccagatgggcgtatcgttaatggtcatgatttcattggtaaagcccaaaaaggtcgtatagtaactttcattttagacactcgtcctaatgataatgtagagtggttagcaaaaaatgccgatgttctggtgcatgagagtacctatggttcaagcgaagaagaggcgaaaatggccaaagcccatgcccattcaacaagtgcaaatgctgcaagtgtggctcgtcgggcacatgtaaacaaattagtattgacacatctttcagctcgctatattgggccgatggttaaagaattaatacacgatgtccgtcgcaactttgctaacacgtatgtggcacgcgactttgacattattgatattccttttaagaaagatagtaatgaatcaaaataattggaacattctgccacaaccaagtgaaaaggttgttcggcagttaagcgcacaactaaatattagtcaatttatgtcaacaattgtggctcaaaggggttatacagattcagaagcagcttttaaatatctacaaccaagtgtagaacaattgcatgatcccatgttacttcatgatatggatagaaccattgagcgtctacaggacgcagcttttggtggtgaaaagattgttgtgtacggtgattatgatatggatggtgtcactagtacagcaattatggttgaagccttagaagtattgggggcagatgtaacaccttacatacctaatcgcttttcagatggctatgggccaaatattgatacgtataaaaaacttattgctgatggtgcacaattgattgtgacagtagataacggtgttagtggtcaagaagctgttgaatatgcgatgagtcaaggtattgatgtcattattactgatcatcacgaaatgcctgccacattgccaaacgcttatgccgttattcacccaagacatccaaaaggccagtatccatttggtgatttatctggcgctggtgttgctttcaaagttgcccaagcattattaaatgaagggcaaccagttgaggatcaaacagagctaccaactgagttgttggatctcgttgcgttaggtgaaatttctgatatggtgtctttgactgacgaaaacagggttctagtttcatggggattgaaacaaattaatgtttcgccacgtccgggtctaaccgcagttttgaaaaatgcgggtaagaaagataatgaaccagttatttcagaaaccgtttcatttaagattgcccctcgcttaaatgctgttggtcgattaggggatgctagcttatctctacaacttttgttaagtcaagatccagaagaatcaactgccattgcttctgaagttgaggccattaatgcgcaacgtcaagaaattgttgaagaggtatttgggtctgcaaaacaaatggctttgtcagacgagtacaaaaatgatcaagtcttggttattgctggtcaagattggcatcaaggaattttgggtattgtggctagtcgattggtggaactattacaaaaaccaacaattgttttaagtttaacggatggtgtttataaaggatctggtcggacttttggtgattttgacctctatcaatttatgaatacctttcacgatttgtatgatacgtttggtgggcatgccagtgcactaggactagctatttccccagagcaactagatgtattaaaagagcaagttcgtttgaactcagctaaattacaaattcatgccaagccgattagtattaatacgacactgtcggttaatgaaatcagcactgaaacgtatgaagaactacgcctgcttgaacctttcggtactggaaatcagcaaccagtgtttggattgcagcaaccaaaaattaataaagtaacaaccatgggaaacttaaagcaacatattaagttagctttagaaaataatgttgaagcagttggctttaaccatccagattgggtgcctatggttgctaatccagtagggatatcatttgctgcgactctgggtattaattatttccgtgggcgcaaaacgatacagcttctactaactgctattaatacatcagaggcaactgatgaaaatgctgctcataaaaagttttttgctcaagtatataaattcatttacgcacatcaggatctaaattttgcgcagaacttggataaaatagcgaaacagttaaatatcaataagaacgatttgaatattatgattcaagtatttattgaattaggattcgtgcatgttaccaatggatttgttacaattatttcgggagcagcacaaaaacccttaaccacgtcaataacataccaaaagtatttggcaaatcgttaaaaagaaagtatgagcgatagctctgagatttagaatgacagtagatttacatgattttgttgcaacagttgaagattaccccgaaccaggtgttagttttcgtgatatttcaccattgatgggtgatggtgtggcctataagcaagcagtagatgctattgctgattttgctaaacatttaaacgttgatttaattgctggtcctgaatcacgtggatttattgtaggttctccgctggcgtatgcgatgaatatcggctttgttccagctcgtaaaggtggcaaattacctcgtgaagctgtatcagcatcatacacattagagtatggtggtgttaatgagttagaaattcataaagatgctattaagccaggacaacgtgtgctgattgttgatgatttactagcgacaggtggcactattaatgctacacgtgaaattattgaaaaacttggtggcatcgttgctggtgtagcttttattatagaattagaaagcttgcaaggccgtgaaaaaattatgaaagctggtgaagtgccattcctagctttaatggaatattaagtttttttaagcttagtgtaattggcagtatgccgtaaaatacttagaacaataatatacattatattgaggtgctactgatgaacaatagtaacattaaagagtggtttatacgctttttcaaagggatattcattgctctagggtttattcttcctggtgtatccggtggcgtattagcagcaattcttggcttgtacgaacgaatgctgaacttcatggcgcatttgaggcagaattttaagaaagatttttggttttttctaccagtgggtttgggtggtatcgctggtattattttattaagccgaccattagaatttttgcttgttgaatataaagcaattattttgtgggggtttgctggtgccattgttggtactttaccagctctgacaaaggaaagtggcaagcatgggcggagcccgagcgattggatattattcatcgtcacaatagttgctggtggattattcctatataatatgacggccatctttgggacgatgccaattaatttcttttcttggatgttggcgggggcactaatcgcgttaggcgttattgtcccgggattaagtccatcaaacctgttgctatacctaggattatttgacccaatgttagccggatttaaacgtgctgatataagtgtatttttgccaatagcacttggtggtatgttgacattaatccttttttcaaaattaatgaactatcttttacatcactattatgctaaggtataccatttcattttaggtattgttgtggtgtcaacgcttttaattgttattccaccagtcgctgattatagtggctttaacataatgagcggatttataagttttatcttattcatcctcggtgtatgggctggtcactggatgagcggcttagaagaaaagtacaaataaaaaacgatcatgtgataatttctatcgccagatcgtttttttattgtactaaccaaacttgatcactaataaaatcaaatggttgatgatgttgatttaattttttggggcgtgctagttttgcattctgccaaaataattgtgaattggttgcgccatttttttcaccaatgacaataaaatcaccattaaagtgttgcgcacgtaggccttgtagaacttgccagtccgtttcatctgtatcaggtgcccagcttagaataaccacatcataggacattgcttttatagcttccaatgcatctaaacagataacttctgtccataaatcaggatgctgtatatcttgaccgtgccagtcgaagttatctgttgcgatgacgttattgccaaaaaggcgcaattggctagaaataacgccatttcctgacatgatttctaaaactcgtcggccatcaataaattgatttaaatccgataaccaaagcttatttggcaaatgccagacgccaaaagacttaataattgtttgtcgaaattcagaaagtaaatcatcaagaggcatcagtcgtaaatcggatagaatatcttgactagaaaaactaagctgaggtagggggttttcgggtaaagtatgctgagcaagggactgtaatgccttacgagctgcatttattttaaccaacgtatctgggctgtcagaaaattgctgagcatattgcgctagtttaatcttcatcgtcatttgttacatcacgtcgatggtttaccttggtaccgtccttactaatatgtatgttgaaatgtttaccatttctaacaaactcaaattcgttatctttgatattttttctgaaacgccaaaatgcaactaagccaataatgccagcaacagcagctataattaaggcaacgaagagtgcaatgccaataatgctaagtacgaccggaactgctacgccaataattgttaaaatgacaggaatcaaaattaacagcccaataatcgctgtaaccacggccccaataaattgaaatatctgtttcataatatttttcctccttgtttattatactatagttttggagagttttattagatttataaaaaagtattgacatataaatgttattagggtatattattactcatagaaacaagcgagtaattcgctcaaaaaatggagacgcatcatggctaaaaatgtacaagcacatcaaaataacgcactcctcctcaacctccttctcatttgagtctagtaggttgttatttgagcaataatcagctactagactttactaaaagagtcagagtagctggttaggtaggaaacgtcctaacgagcaatcgttgggacgttttatttttctcaacgattgttagtagctcatattggaattaagttattaaacaggagaaataacatggcacaaaacgcaattacaccacaacataaaattgatacagatcaaattaaagaaaaagtagctcaagaaaaagagtcagttcgtgacactgtttataaagtcagtgcagctgtctcaaacgccattttggttaccttgggtatgggattgttgctgcagacgattgcaggattcatccactgggcaccgatggtccaaatgggtgcaatcactaaaattatgttaccagcagcatttggcgccgcgattgcatcacaaatgaaaacgaatacaatggttatgtttagtgcgatggctgcctcagcggttggtgccaacgctgttttcttcacagataaagccgtggagggtgtaacagcaaccggatacgctggtgcacaagctgctggttcagccataatgaccactggacaaccaatttcagctgttatggctggtgtgattgccgtattgtttggtaagtggttgagtggtaagacaccattagatatggttattgtaccagcggcgaccacaattgttggcacggtgtcagggtactacttggcagctgttacgacaccggcattggtcgcaatcggaaagtttattgcttcgagtgttgcagttaatccaattattggtacagccattgttgcaatggcctttggtgcaatgaccatgacaccagcctccgcagcagctttagctgtggcaattggtgcaacaggtgtaacttcaccagaggctgcaggagcaatcttaatcggtacaacggctgtattcgttggcttccctgcaatgtcatttcatgaaaataaaattggcgcaacaattgctcaaggtattgttacaccaaaaattcaatttccaaatttgactgaaaatcctgccttgattattccaccaatgattggcgcagcaattgctgcaccaatcgcaacaatcgcgtttaatgttactgcacctttctcaatggctggtattggatttaattcatttatcgttccgttggcattggctggttcaaatcctgctgcatttgctgcttacatgattatcggtgtaggtgttcccgtgattgtttcatttgttggttatcgtttcatgcgtaaaatgggttgggcaaagccacaacaattgcacttggagatgatttaatataaaaaagcatgagtcgctaattgagacatcatgcttttttattttgtgtatgttgagcgataggataagttatttggccctttgagccagttaaagtgttttaatggatttgattttacgccccaaatatcgagtaacgctgcaattgcaatatgaacaggagcctgagcatcaaatgtgacattcaattgattatatagaccatctggtcgattttccggtttcacactaagcaattttttggtattgtggtatatgaagtatcgatttgcaatgaaattaccagatattaaccagcttaaatgtcgaacataaacaaagtcactaatatggcctagtgtaaaactaattgacccgacgatatgcccacggtagttgagggtaaatcttggtataataccataagatgtttggcggatgcgcaccaaaacgcgaccggacatgtcttgaacttgaatttcgtcagattttttaccagaacggccagacactaaataagacgctttaaaatcttggtcgaaaacaatgttgacgccatcattaatactatgtcgttgacgtaagtaatattttgtcatttgcaaacctcgtattcaattacaagtttatcacgaaagaagaagaaaatgccattatcacatacaacttgggcaccagctgttaaagccaagttaaatcctgagtatttaaaacaagtcgcgcagtttattcaatcaacttaccgggaagatgctcatatttttccacagcaaaaaaatatatttgctgctcttgagaaaacacctttgcctgagacgaaagtggtcatcatggggcaagatccatatcacaatattggtcaggcccaaggattgagcttctcagttcctgaaaacgtgccagcaccaccttccttacagaatattttaaaagagctttcgacagatgttgggcctcgtcaatcacatgatttaaccagctggtccacacaaggtgtattgctactaaatgctgtcttaacagttccagaagggcaggctaatgcgcaccaagggaaaatttgggagccgttgacggacagtttgatccaaattgcttctgaagatgatgcaccgaaagtttttattttgtggggaaagtttgcccaatcgaaacgtcaatttattgatgagtctaagcatctcgtcttaatgagtgcccatccaagcccactatcagcttaccgtggcttttttggaagtcaaccgttctcaaaagcaaatcactttttagttgctaaggggcgacaacctattgattggctgaaatgagtgaataaattcacaaatattgctaaatacacagacttttgtgtagttgtctgttacaattaaattgtaaataattaattcgtagcagcgaatttggaggaatttatggaactttttgagcaattaaaaaataaaattaccggtcaaaataagacaattgtatttccggaaggtgaagatccccgtatccagggcgcagctatcagattagcagctgataatttgatcgagccaatattattgggggatgcacaggaaatttcaaaaactgcccaagcccataactttgatttgtcgaacatagagacgattgatcctgcttcatatgatgagaatgaattggcaaaattaaatgcgacacttgtcgaaaggcgcaaagggaaaacagacgctgagacagctgccaaatggctacaaaatgttaactattttgggacaatgctggtttatactggcaaagctgacggtatggtgtcaggcgcagtacatccaactggtgatacagttcgtcctgcgttgcagatcattaaaacggcgcctggctcatcacgtatctctggtgcattcattatgcaaaaaggcgaagagcgttatgtatttgcggacgctgccattaacattgacattgattcggacacgatggctgaaattgcaatacaatcagcccacacagctcaagtgtttgatattgaaccaaaagttgcgatgctttcattttcaactaagggctccgcgaaatcacccttggtcgataaggtggcaactgccactgcattggctaaaaagttagcacctgaactggcggactcaattgatggagagttacagtttgatgctgcgtttgttgaatctgttgctgccgcaaaggcgcctgattcaaaagtcgcaggtaaagcgaacacatttattttcccaagtctagaagcaggtaatattggctataaaattgcacaacgcttgggtgggtttgaagcgattggacctattttacaaggcttagcaaagcctgtttctgatttatcgcgaggagccaatgaagaggatgtttataaagtagctattattactgctgcgcaagcattataagtatataaaaaaagacctaactgaaaagttaagtctttttttatgcggataacaggaatcgaacctgcacggtgttgccaccataccgacctgaacggtacgcgtctgccagttccgccatatccgcggttcaacttttttattatacctgaaaaagtaagggttgacaaatttttctggtatagtactattaaattattcaaagaagcagggatgtattatgaacaaattattcttcaatcaaacatcatcctccactcgaccactcatgtgatcgggattctttgcgtacagataacgtagaaatgacggacaacatgggtgtgtatacttgtgttgtctttttgtatattgaaagggatttttaatgacaaactataatttttctgctggtccaggtgttctaccgacgccagttctcactaagattaaaaatgaattcatcaaaaatgaatttacgcatatgtccatcatagaaatctcgcatcgctccacgcaatttgaagaaatcattaacagcgctgaagaacgtttgcgtgatttaatgaatatatcagatgattatggtgttgcatttattcagggtgggggatccacgcaatttgaaatgttgccacttaactttgccaataataagaatagaattgctgttttagattcaggtaactttgcctcaaaggcagcgcaggcagcagttactattgggaaacaagcaacaattttggacagctccaaagtggatcattatcatcatttacctatgttatctacagatttcaacgccgatgagtatgattacctacatctaacgaccaataacacaatcgagggtgctacttaccaccaatcgattttgcctaaaaccgttggtcgattaacagcagatatgagttcaaatattttggcagagccatatgatgtcaatgattttgatgctatttttgcgggggcgcaaaagaaccttgggccagctggtgttacggttgctatcgtcaaaaaagattggttaaaagaacaaaatattgaaaatgtaggttcaatgttgcgttatcaaaactacttggacaagcattcaatgtataatacaccgccagtattttcgatttacgctctgaacttagtacttgagtgggtacaagagcagggaggcgttgacagtatgtatgcgcaaaatattgagaagtcttcaaaattgtatgattacctagataactctacattttatcatgcattggttgatgaatcggcacgttcactgacaaacgttgtctttactacagcagacttaaaacgagatcaagcaatagccaaagacgcaactaaagaaggtttatttaatttaagtggtcatcggtcggttggtggtttccgtgcttcattatacaatgcacaacctattgaagcagttgatgccttaattacatttttgaagaaagcagaaaataattacaaatgacaaacattaaaacttataatgctattagttctaaaggactggactatttgaaagaccatcactacgacattaacggtaatgatgcgccaaaaggcatcttgttacgttcacaaaatttacacgatgaaccaatcgatgataatgttcgtgccattgttcgtgctggtgctggctttaataatattcctgttgaggaattatcaaaacgtggtattgctatttttaatacgcctggtgggaatgcaaatgccgtgaaagaactaacaattgcatcactagttttggcagcacgaccagtagttggtgctatacaatttgctaatgatacacggggcggggatgtgtctttgcgcactgagtcaaataaaggtggttaccgtggcacagaactagcaggaaagaaactgggtgttattgggttaggaaacgttggatcaaaagttgctaacaccgccttagctcttgatatggacgttattggttatgatcctgggttgaatgccaatacagcttggcgtgtcgatcgtcatattgttcatgcaagaagtgttgaggaagtattagagcaagccgactatgtgactgttcatattccattagaagagaaaaatcgttatttcattgatgcggataaattgcatctgatgaagccaacggctgcgttactcaacttgtcaagaggcggcattgttgatgatgaagctgcaaaggaagcgttggataatgatcagttacgtgtctatatcactgattttgctgacagtgttttgtttgataatcctaaggttattattacgccgcatattggtggatcaactattgaagcagaggacacgagtgctttgatggctgcacgtcaactagatgagtatttaacaacaggaaatattgtaaattcagttaattatccagatattaatgaaccattcacgactaagtatcgcgttggtattattcacgaaaatgtgccgaatatgttgggacaaatttcaaagttctttggtgatcataatatcaacattgaacagttaagtaatcgtgctgttggaaattatgcctatacaatggtggcaattaacgactttactgaagaacaacaagagttggtaaaaacggctttggatgaaattccacacgttatcttaactcgtcgttatgttaacccaagaatataaagaaggaaaaaccaaaatgactaaagaattacaagaatcagcaatcacaacgctcgcacgtcgaggtgtgactaccaatgatatcgccgaaggcacacgtacatttttgagtaacaaatacaaagataccattaatgaagaagtattggccaaatctattgcacatgttctttacaaagatgaagtagctgatattattttgactgcgatataccttgatgagcaagcagaagttatgcccgatgaccaacccttaaaagcacgcttgcaacgcgatgccaatggtcataatgttgatgaaattttggcaattgcaattacgcaacaattttctgcggctgcaacagtgcattatggtttgttagatgacctaaagccagggttaattggagaaattaacgacaagaccgatagcattaatgtttacttagacgatattttggcagcattgattgccagttcagcaatgtcatatttggagcttttgggcggtaatcaatattaatgatttaaactgtgcttactggaaattgtagttattttttgttaaaatagaagcgttattcattaatttcaaggagatgacacaatgtcaggacatagtaaatggcataacattcaaggtcgtaaaaacgcccaagatgctaagcgtggtaaaatttttcaaaagatagcgcacgacttatatgttgctgcaaaggccggcggtgcagatccagatatgaacgcgtcattgcgattagttgttgaaaaagctaaggccgctaacatgcctaaggaaaacatacaacgtgcgttagataaggcttctggcgcaaatggcgctaagtttgaagaagtcacttacgaagggtatggtactgctggggtagctgttctcgtcgaagcgtctacagataatattaaccgcacggtatcaagtgttcgtaactcattcaagcacgctggcggtgcattgggaacttcaggatcagtggtatttcagtttgatcgcaggggttatcttgctattgatcgtagtgcgtttcccgatctagacgaagacacagtgctagaggctgcgttggaagcaggtgcggaggacgtgcaaacttctgatgatgtttttgaaatctatacagagccagctgatttccaagctgttgaatcggctttgacagaagctggatatgtttttgaagacgcagaagtgacaatgatcgctcaaaatccaatggacatttcagaagaagatcgtgagaagttggataagttagtcgatgaattagaagataatgaagacgttttggcagtttacacaaccgctgattaggtaggtaaaatacatcaatggatgtatttttttttacaattactttcaaaaaggacaataattgtctttcatatttagctgaaagagcaataaactaagacatacactataaatgttagaaataattagtaatattctcaaaatataatttataattatggtaaaatggataagtaaaaagcgattaacgtatttaatgttcgttttttactaaaaaagcaacattgatagagggacactcacggataggtgcaaacagattaactattttttgtaatagttagttttctccgacaagcctatcccgtctgaaagcagctattagtgttataggagaaaaaatatatgtctggtgtaattgttgttggttcgcaatggggtgatgaaggaaaaggaaagatcgttgactttttcgcggaacatgcggacgcagtagtgcgttatcaaggtggtaataacgcaggacacacaatttggcatggtgatacaaaatttgagttatcagcattgccatcaggaattgtcacaaagggacaacttgctattttgggtaacggtgtggttattaatccagaagcattgttagcagaaataaaagaagttgaatctcagggtgttacagttgaaaatttgattatttcaaatcgtgcgcatgtgattatgccttatcatatcgcattagacaaagcatctgaaacagcatcaaataatcgtattggtacaacaaaaaagggtatcggcccagcttatacagataaaatttcacgtgttggtattcgtgttgctgatttaattgaccctgaaatttttggtaagttattaaaagagtacttaccattcaagaatgcgcaattaaccaagttatatggtgaagaagcgcttgactataatgaaatatatgataaatatgttgaatatggtcgtcaattggcaccgtatgtcactgatacatcttacttacttggtcaacaaatgaaagaaaacaaacgtgtagttttcgaaggagcccaaggggtcatgttagatgtagaccacggcacatacccatttgttactagttcaaatccaactgctggtggcgttatgaatggcgcgggtgtagggccaaagcaaattcaagatgttgtgggcgttattaaagcttatacatcacgcgttggctcaggaccattccccacagaattgtttaatgatacagcggaccatattcgtgaaattggtcatgaatacggtgttgtgacaaagcgcccacgccgaattggttggttagatgctgttgcattgcgtcatgcagtgcaagtatctggcttaacgaaactagctattaattcattagatgttttatctgggttaaaagaagttaaaattgcaacatcatatacttataaaggtgaagaaattcatcatttcccagcatcagatacttggttccaaggactagatgttaattttgagacattgcctggttgggatgaagatattactgatgtcacgaagtttgacgaattaccaattaatgcacaaaactatttgaaaagaatttctgaattattggaagttgatctattaagtttcgctgttggccctaagccagaacagacacatttattgcgcccagtttgggaataaacagtacaattaataaagcaaataagatgaataaattcgtcttatctgctttttttttattaaatatacaataaaatagcatatattcacttttatactgtatataaacgaaatattattgcatatttaatcaaacggggttaatatataatcatcgaatagctaaagaaaaaatgatgagggcaaaattatgacagacacattagtattagcatactccggcggtttagatacttcagtagccattccttggttaaaggataaagggtacgatgttatcgcagttgttttggacgttgggcaacatggcaagaatttaaataaaattcaagcaaaagccttaaaagttggtgccaaacaatcaatcgttatcgatgcaaaagctgaatttgcagataaatatgttgcaccagttattaaagctaacatgatgtatgaaggcgaatatccaatggtatcagccctgtctcgtccattaatcatcaaaaagttagttgatatcgcacatgaaaatgatgccgttgcgattgcgcatggctcaacgggtcatggtaacgatcaagtacgtttcgaggccgcaattcatgcattggaccctgacatgaagattgaagcacccattcgtgatttccagtggtcacgtgaagaagagattcaatatgcacaagaacatgatgttccggtacctattgatttagattcaccatactcaattgatgagaacttatggggacgtgccaatgaagctggtatcttagaaaacccatggaaccaagcgccagaagatgcatttgcattaacaactgccattgaagatgcaccagatacaccagaatttatcgatgttactttcgaagctggtgtgccagttgcgcttaatggtgaagtattgtcattagaaaagctcattgtggcggttaatgagattgctggaaagcatggtattggccgtatcgatcatattgaaaatcgtttggttggtattaagtcacgtgagatttatgaagcaccagctgcagctgtactgatgacagcacataaggatttggaagatttgacgctagaacgtgatgttgctcatttcaagccaattgtggaacaacagctagctaatttggtttatgaagcgaagtgggtatcaccattgtttgatagtttaatggcctttattgatagcacacaacaaaatgtcaatggtgtggttaagatgaagttgtttaagggtaatgccactgcggttgcccgccaatctgaacacaactcactatacgatgaagatttggcaacatatacatcatcatcatcatttgaccaagcatctgcggtaggctttatcaaattgtggacactaagtaatacggtttatgaacaagtcaaccatgtccattcacaagcgaaaaagaacacagtgaaataaaaaatacgagcctagctcgtgtacatagatagcaataaagggagtaatgaataatatgagtgataaattatggggtggtcgttttactgctaaagctgcagaatgggtagatgaatttggtgcttcaattcactttgatcaaaaaatggcagctgaagatattgaaggttcgatagcacatgcgaaaatgcttggcaaacaaggcattataagtccggaagaatcagcaaaaatcgttgctggtttgaaaatcatcaatgaagaactcattgctggaaaaattgagtttgacgttaaaaacgaagatattcatatgaatatcgaatcattattgaccgagaaaataggtccggtggcaggaaaattgcatactgctcgttcccgtaatgaccaagtggccactgattttcatttatgggtcaagcatcgtttgccccacgttctagaatctctaaccgaattgcaagaggagttgttaactttggcgacaactcatgcaggaaccatcatatctgggtatacgcatttgcaacatgcgcagccaataacttatggtcactatcttcttgcttactttgaaatgtttcaacgtgactatgaacgtttcgaatttaaccaaaagcatacagacattttgccgttaggagcagcggcattagccgggacaactttcccgattgaccgtgaatttgttgcttcagaactgggatttgacagtatttatcacaactcattagatgccgtgtcagatcgtgattttgctttagaattcctgtcaaacgccgctatattaatgatgcacctttccagaatggcagaagagttaattttgtggtcaacttacgaatttaattacattgaactatcagatgatttttcaaccggctcgtcaattatgccacaaaaaaagaatgctgattttgctgaattagttcgtggaaaaacaggaagaagctatggcgcattaatgggtctgttgacaacgatgaagtcattgccactagcctacaacaaagatatgcaagaggataaagagcaggtctttgatattatggatacggttctagcctctgttaaggtgtttacgggtatgctaagtggcttgacggttcataaagagcgtatgctggccacaacacaagatgatttttcgaatgcgactgaactagcggattacttggccactaaaggtgtaccattccgtgaagcccatgcaattgtgggtcaattagtcttgacaggtattcaatcaaaaatgccattacaaaaaatgtctctgtctgatttgcaagccgtagccccacaaatagaagaagacatttacgacaaactacaatctgaaacagcagttaaccgacgcacttcgttaggcggtacggctgttgaaaatgttaaaaaagaaattgtaagaaataaaaaagttttggaggcaaggtaatgcattcacattttcaaggaaaatcttttcttaaagaaattgattttacaaaaaaagagctagaaacattcattgatttggctgcgcacttcaagtatttaaagcaaaataatataccgcataaataccttgagggcaaaaatattgccttgttgtttgaaaaaacttcaacgcgtacgcgttcttcttttaccgttgctgcaaatgacttaggcgctcatccggagtttctaggtaaaaatgatattcaatttggcaagaaagagtccctggaagacacggcaaaggtttttgggagcatgtacgatgcaatcgaatatcgcggattttcgcaagctacagtggaaggattggccacttacagtggcgtgccagtctggaatggtctgacagatgattggcatccaacacaaatgttagctgattttcttaccattaaggaacaactaggccacatagcgggtattaccttagcctatatgggtgatggtcgaaataacgttgctaattctctgttggtaacaggggcaatattaggtgttaatgtgcatattgtatcaccaaaaagtttgcaaccaagtgaagaaattctaaatatagccaaccaaaaagctgctgaatcaggtgcaaaattgcttgttacagatgacattgatgatggcgtaaatgatgttgacgtcttgtacacggatgtgtgggcttcgatgggtgaagaagatacgtttgaagaaagaataaagttattatcaccttatcaaattaacgcaacattagtcgaaaaaacaaacaacgaacaggtaattgtgttacatgatttaccagcatttcatgatttgaatactaaaatggcgcaagatatttatgacaagtttggtattaaagagatggaaatcactgatgaggtctttcatgcttcatatgcgcatcaatttgagcaagcagaaaaccggctacatacaattaaagctgtcatggcagcaactttaggaaatatgtttattccggagctgaattaaaaatagcaacaagaaaaaggagcctaaataattaggctcctttttcttgttgctttgaatttctaatgaaataacagaaagaggtcacttaagtggttgccagcgccaatcttctacttcgggcaagtccgttccctttgacctagtatacgcaacgtgtaggtcgagcttatcggtcatttcttgcacgagggctgcttgcttggtgcgaatattttctggcaagagattaatagcagctttaactaaattaaatcgatcaattttgttaagaacacgcatatcaaatggtgttgtaatgtcaccaacttctcggtaaccatgaactgctaagtggtgattgtgtcgtttgaagaaaatagattcaatcattggttcatagccatggaatgcaaataatactggtgtgtcagtagtgaagtaagcatcaaattcatcatcacttaagccatagctggcatcggcccgtagtttaaatagatccaatacattgatgtaacgtatttttaatgatggtatgtgttcgtgcaaaatttgtattgctgctaaactttctgtcgttggttcagaaccagctgaagcaataataatatcaggtttttcacctttgtcagtacttgcccaatcaatgacacgtaatccttgcgtaacaagctgtttggcctcagtaggtgagaaccactgtaagcggggatgtttgctggccacaatataattaatctgttgcgttgcttgcgcagcatgttcaaatgttgcgaccaagctattagcatccgctgggaagaactcgcgaatgaagtctggttgcttttcatacaacattgttgttacaccaggatcttggtgtgagtaaccattatggtcttgttggaaaacagttgaatcagcaataatatttaatgccggcacgtccttacgccatgaaacgtcatgagaatgattcaaccacttaaaatgttgcacaatcatgtcatcaacttcacgaataaagacctcataactggcaaagaatccatgacgaccggttagcgtataagcttcaagcatcccctcatcataatgctctgataacatagaatcaataatacggccttcaggtgccatgaattgatcattaggttctttgattggtaatagccattggcgattagttgtttcaaaaatgtcttggaaacgattagaagctgtttcatctgggccaaagccacggaagttagtaggattaagtttgatgatatcacgcaaatagtcacctaacaaaatagcatcttgagctaagttattgcctggctgattattttctaccaaataattgtcaatgtcaggtaaaatcaaaggtttgataataccagcattggtgaccgaattattggccatacgtagctcttttttcggtaatacttcttggatagattgtgttaactgaccgttttcatcaaataattcatctggtttgtaagattgtaaccaatcaacaagttgtggtatatattcaggatgattttggtcagcaggaattggaatttggtgtgcacgaaatgaattttcaattggcttgtcatcccaagtttttggccctgtccagcctttaggtgaacgtaaaacaatcattggccaaagtggtcgtgtaatctcttcatttgtctgctgaacggctttttctctaatgtctttaatctcagtaaatactgtgtccatggtttttgccatttcttcatgaacttgcataatcggtttgtcaaaagaacttacaaagtaagggtgccatcccagactgtggaaatactcggttagtgtttcatcagattctcgagagagaactgtgggattcgcaatcttgaagccatttaaattcaaaattggtaatacagtaccatcatttttaggattcaaaaatttattaacatgccatgaagtggctaggggtgctgtttctgcttcaccatcgccaacaacaaccgcagcaatgaggtctggattatccaatacagcaccagcaccgtgcaagatagaatagcctaaagcaccaccttcatgaatcgatccaggtactttaggatcagcatgtgaagcaacgccaccggggaaagagaaacgcttaaacattttctgcatacccgcttcatcctgtgtgatttctggaaatgcttcggtataactaccatcaagataagcatttgaaatcattacttgtccgccatggccaggcccctcaatgtaaaacatattcaaattaaatttattaatagcacgatttaaatgggcataaataaagttttgactaggaatcgtgccccagtgcccgattgggtgaattttaacttgttctgccgttaacttttccttaagcaatgggttatctaacaaatagagttgtccaactgacaaataattggtagctcgccagtaggcatctaaattgttcaggtaatctgttgaatcgatattcatttgatacttcctccaatttgtgacaatgcatacacaaagtgcatgctacgattgcgtaaaaaatattgcaagatataaaattaactttgcaaagtatagtgaaaagttcagaaataaattgataattaatctgaacctggcgaacaccaattcattatcaagccgtgtttttacatattcatcgtaaaggttgttttttgaaaagtcaataccaatacattaattggtacgacccaattaatgtattggtattgacttttatggttataatcgcgtcataacgggaattagcgtcttaacattactatttgataaaataatttgtttgcatacttctgaacaagtgtgttacactcgattttgttattagtcgattaattaacatactaggggtgcttttaaaaaagctgagagagaagagataatctttgaaccctttgaacctgatctgtagcaagcagcgtaggaaagtatgaatatatgatttttttgcaatcatataaacagccatactatatctaagagcgtttgcaatataactgttattattgcaaacgctctttttctatgtgttgaaaatttaggaggcaattttgtgaatcaacgtgtttttttggcggcacctttcaaacaacttttgaatcaaaacaatcgagtcaatacggaaactacacaggcactgcagcaagtaatgcaagtgttagaagataaaggaatgtttgtggataatgcgcacaaacgagagaattggggattagaaatgatgacccctactcaatgtacagatgctgattttaattccataaaaaattgtgatgttttaatggcttttccgggtagcccagcatcaccaggtacccatattgaaattggctgggcgtcagcatttcataaaaagattattttgcttttaaagaatgatgttgactatgcatatttgatacgtggtcttggtgtaattggggacgtagagtatatctattacgaaaatatgaatagttgcctttcacaaataagtaatgtgatagacaattatctacaacacaataaagtattgtcaaagtagcgttgaatgagggagttgagttaaatgacaacatatgaaacctttgatgatgcctatatagccgaactaaatgaaatatatcatcatgcagaatttttcaatgagcccagaggatttagtagtcgggaaaaattaggtgttaattttaaaattgaaaatcccgtacagagaattgtatatagccaaacgagaaaaacaaatattatctttaattttgcggaggcattgtggtatctaacaggaaacaatagcttgtcttacatcagctattacaataaacgaatgcctgattattcaatggacgggcaaatactaaccggtacggcatacggcaaaaagctgtttcattttggggaacaaaacctaaatcaatggcagaacgttaaacaagaactgctaaatgatgctgattcgaaacgagcggtaatccaaatatttgatgcgcacgaattaacaattaatcaaaatttagatgtatcttgcacattgggattgcagttcttaattagaaataaccaacttaatatggtggcttacatgcgagcaaatgatgcgtttcgaggcatagtaagtgatattttttcattcacctttatccaagaatttatggcacgagagttgaatcttaaagttggaaaatattaccatagcgtgggcacaatgcatatttatgaacctgataatcagtgggtgacgcatgtgctcaatgaatcaaatgatcaaacatttatctctcctaaaatgccgcaaggaaataattgggcgatggtacatgagctaatgcattatgaagaaaaattaagaaaaaaagaactaacaatgaattgggtggacattcaacagactgagttatcgtcgtattggcaacaaatattggccttatttagtatttaccaaatgatttattatcacgaggaagtagaccaggtgttatttgaccatcttttgccagtatatcaacatcttttgctgaatagatggccaacgaaaatgagtagggggatggtgtccaatgacagaaaatttatttaaggatgaagtcgtggctaatcagtttaacgactataatgacgtattagaacaggttttgggatataattttgttttgtcgattttgaaatcgactcaagcaaagaaaatattagactatggatgtggccctggaaaagtttcgctgcgtttagcaaaccaactatcagccgatatagttgcggttgacgagtctgctaaaatgattgaaattgcgaaaagagagcgtaagcatcagcaaattgattataaaattgttaaaaaagataatttagattttatctctgataattcagtagatggtgcgattgcgtgctatgtttttattaacaatcagtctgaacaacgaattttaaagattatgagggaaatttatcgaacattgcgaccaaacagtcacttcatcattttagatactaatccaaataccacgggtgtaccattttcaacttttcaaaatggtgaaccggggaaatcttatagttatggtgaagaacgtgttgaaaagttgaatctggactcgcaagaaaaacttattttgcatgattttaactggccaaatcgtatgtatgaaaagaatttaaagcgagcaggatttagtgaaattacagttcggtatccaaagttagaagatttttcagcagaacaaatccaacaaatagaacaagagtatcactataagagttggttaaatgaaaaaacacaagcaccatttattttataccaagctataaaaaagtagatttttcgaggaacaaaaaaagaccaaagcatttgttttggtctttttattattttattttcagttttgaaactaaactagcatcgggcgtaacatatagtgtttgctgtccttcaaaaataacaaaacctggctttgaaccatttggtttgcgcagttttccggcaggtaaataatcgacggggacattggcagattcacgcgccttgctgaagtaagcagcgagctttgcggcctcaataagcgttgtatctgaaggattagaatcatgaataataacgtgtgatcctggtattttttggacgtgtaaccaaatatctcgacgatcagcttgttttaatgaaagtcgttcgttttgcaagttgtttttaccaacttcaatcaacgtaccatcggaactttcgaatttatcaggttttgatacctttggtttttgtttatttttcttattggctcgaatgtatccctcagcggttaattcgaggcggatatcttctacgtcctttggagatgcaacatctaattgtgcgacaatattattaaaataatcaatttctgcgtcggtcaacgcaatttgctcattaacaaaatctacggccgtacgtaatttacggtatctgttgaaatatttttcagcgtttttcagaccgtttagtttaggatctaaggggatttctagtaaattattattatcataataattttcaatagatacgcttttcattcctttttgaacgaggtgagggtaggtaattaacaaatcgcctttgacttttaactcatcagcattttcagcgtcttcaagtgtttttaataatttttttcgcttagccgtattttttttcaattcgtttttaacaacccgaacgagggtaccggcttgttggttgacacgttctctttcagcttttccgatgtaataggcgtcaagcatggtgcctaacgttggaaattcttcttgtgacacgctgtcttgcaaccagtcaaaggcagagtagctaagagaaccatcttttgaagtgaaaagtgtgggggcgagatggtcaaaatgagccaaccattcacgcgcatgcgctaattgatcacctgcctgattaattgctcgagccaatgcttccgcggattctcttccgaatccctgatacgttttttgaatgtatttaggccattcttcgagaggtgtatctaggatcatttgagctaaaccatctagccctgcagtaaacggattcttcaaattctgggcaggcggcaaaacataagttgcaccaggaatcaaagaacggacacgattttggtcggcaggaacatgtttaattagttccaggatacgggcatcactttcacgaactaaaaataggtttgagtggcgtcccatcatctctaaggttaagcggatttcttgtatgtcccctaattcattacgtgcattaacgtaaaaattaatgatacgatcattttcaacttgctcaattttttgtaatttagcgccttctaaatagcgtcgtaaaaacattacgaagttgggtgcagtttgcgggttttcgtagggaatacgtgtgatttgggcacgtgcgtagctgggatgagcactcagtaggagcggataattctgcccattattacggaccacgagtacaatttcatttgggtaaggttggtgcaccttggtgatgcggccacctgtaattaaatcatttagttcatgcacaatcgcgtgcgtaaatagtccatctaagggcattctgtgtacttccttttatcatttgttgcagccgagaaaatatttatatcatagttacaaacgttttatttgtttaatttatcattctttaattgtatcacgtaataatagcggagttggctcacttctaatattcgtatgcataaaaaaacaaactacttaacctagagtagtttgttttttatttaaatcaatggacaggcaaggggctgcttgtctcaatggcggaaacgatttcttccagtgattggctaccaaaaataacattatcgctattattaataatcattgcgggtacactcatgatatgatgtgactcgcgtagttcagggaataattgcaagtcaatcatttcggcagttacattatcattaattgcggcaatgtgttggcaagcagccacaacatctggacaaaaatgacaagttaatgacacaccaatattcagatctgtttttggtaaacgctgtatacgttggacaagctctgtatcaattgtttgacctggcccagcaatattatagagcgctagaactagagaatttaactcatgtccggtaggaataccactaaattgaattccagtatcttcatcattgtcagtaagcaatctaaagtttggcatgtggtgaacatgatatttgctttctagttcagtactagtaggttccattttaaatttcagatggctacttagttggctaaactcttccaaaaatgaggaaagttcatgactttttgatgagtcgtctgtcaattgatgcagggtaacatcttgcgtaagtttatcaaaaataggttgtaaggcttgtataatttcttttgcgaaccactgtccagtgtgagtaggaagggcagaatgatcagttgcatcaatagtacttgtaggtcctttagtaacgtcagtttttggagtggacactgcggaacggttaaccggaatattaagcctgtgcttttgttctgacacaaatagctctgcactagtagcggcattggcaccatcagaagccgccgtgacgatttgtctaagtggcttagaaatgacatccccagcagcaaacacccccggaatattcgtttgaccctgggaatcagtcacaatatatttgtgctcatccaacgtaatatcatgttggaacatttttgtttgcggatctgtgcctacgtaaacaaaaataccaaatgtattatcaccatcagcaacatggtaagtagtttgctcatttgttttgttgttaataaaggttgcatcagttaagtagttttgaccagccaccgtttgaatttctgtgtttggccaaatggtgatattggggttgaggcgtgcacgatcagcagttagtggcgggcaagtaaagtcattagatcgcatcacaatggtgacatgacgtgcaaatcttgtgaggtaatcagcttcttcagcagcagcatagccaccaccgatgacgaatacttctaatccactaaataattcaccatcacaagttgagcaataggccacaccacggcctcgaaaatcttgctcaccttggaaaccaacttgatgaggttcagaacctgtagcaatgatgatgctacgtgcatggtaagtatcttttttaccagtaactgtttttatgacctcatcactaaaattgtaattagtcacggtatcaaaaacgaattgaacaccaaaactttttgcctgttgctgcattctattgactaatgctgtaccatcaattgtttcaacagcaggataatttgcaacagttgaggttgttgtgacttgcccaccaatttggtcaccctcaataattaaggtatccattgttgaacggccagcgtaaataccggctgataaaccagcaggtccgccacctataataattgtgtcataaatgtgtggttcagtcattgcgtaacctctaaattttaccaactaagtctaagctcggagcaattgtgtcttcaccagggtgccaattggcagggcagacacggtccccatgttcagcaacgaattgtgcagcttcaagtgtacgtaagatttcttcagcattgcggccaatacccatgttgttgatggtatatgactgaatttttccttcaggatcaacaatgaaagttgcacggaaagccaagcctgcatcttcgtctaaaacattaaagaaacgagccaatttaccagctggatcagccaacataggatactttactttagcaattgtatccgtagcttctgcccaagccttgtgaacaaactcgctgtcttcagatacagaataaatttcagcattaatattttggaagtcagcgtagtgatcagctaagtcacccaattcagtagggcaaacaaatgagaagtcggcagggtagaagaaataaacaccccatttacctaaggtatcttgcttagttacttctgtgaaatcaccatcgtgatatgcattcactttgaaatctgttatttctgaatcaataaaatttgtagtcataatttctccttttctttgttagaacaattctaatctgtttttattatacaacgttctgaattcaaaaatcaagaatcattttaaattaaatttttgaatgtgacgaacatagcattcatcctaaaataaaaagcaatatttgtggcgtattttacataaaaatcacataatgttataatgaaaacattgtatttacatatgaaaggaacccaatgaattacgacaattacgtcccgaaagagtcaagaaaagaagttagtcaagagagaattagatttctgaaactgttaagtaaggtagcggtagtattttgttgtttgatgtatatttcttatattccacagattacagctaatctatccggaaatcctgtatcggtacttcaaccattgtgtgccacggtcaatgcaactttgtgggtgacttatggctggctaaagacctataaggattggcctgttattctagctaatataccaggtgtaattttcggtgttgttacggtagtaacggtctatgttcattaaaaatcaagttatagataataaaaagcgttcggctaaatgatttagtcgaacgctttttcagcagttattttatttttatatttcgtttcaatagggcgctttccttgccatttaaaatattttcaacttctatagcaaaggttttgcgacgtacaggacgataacgctgtaaaaattttaatccaggaatgcgttgcagggttacaagaataatagcgggaatataagaataaattcttgatttatcatagacaataccaggataaacattataagctctgtcgtttaatagggctttagccgagtgctctacggttaatttggcccgcaaataggcatttaaaaagaaaggtgtcgcattggcggatacaaacaaaaacttagtttggtgcgttgtcgcaagaacatccaagagtctttgcgcgggctgaacgctactgttttggtaattaatatgtttgaaagggttgggtagcaatattcctacagcatcgacaacccaatccgcttctctgagcaaatcttgccattctccaggcttatttaaatcagcagcgtggtaagtgacttggtcagttgcgtcagtgggactgaattggtgccgtgataaactatgcaattcaaagtccttgttgttcaaagctgataagataccctgaccaacaaaacctgtcccaccaacaacaattatttttttgttatccatcatagctctccttgattttaaaatcgtatcgtgctaaaaattaaacaatttgtgtgccatggacctcattaacgcctagaatattagctatggcttcagcattcatttttgttacaccgccaccaggtaaaatggttaaatttgctggggcgctgttgactagtgtttgcaaatggggcagtgactgcatgattggtactgacagtggaccaccatgagttagtatccgcttgacaccatggtcagatagccaattcatcgcattttgttgtttatggtttgcgatttgatcaaatgccatatgcatgacaacttgtaaatgcaatttatgagcgcaaccaattaaaatagacatactatcaaagtctagttcatcggcggagacagcaccaaaagtgactatctcaccgccaacatcagcaattatttgcatggtatccaacatttgttcgacttcactactactatattcaaaatcaccaccacgtgggcgaaccatggtaacaacaggtaactcattagcaattgctaatgtatcaataatttttttagtatcaggtgtaatgccacctaaatcaagtcgtgaatttaattcaatacgattggccccacgtgatatcatttcacgagcgcgctgcacggaatcaaccgcggcttcttttattttaatcataggtaattagtttttgcctttaaacaaaaaaacccgttcattatgaacgagtgtcattgttactttttatcaataacttgcttgccgttgtaaacaccagaaggtgaaacgcggtgtgaaacgcgatattcacccgttgtttgatccaaaacaatgttaggaacgttcaagccgatgtgaccgcgacgattacgcttgtgagactttgaattcttgtttgatggggtagccataagagcacctcctttcgtttcaatttatcaactagtcaagtttaccgaagttttaaatatttgtcaagggctacggcttattaatgtcaaggaaatttacttgacatgggattggataatttcttgagtatataccttatggtggaaccatgaagattgaaagacaccgatcaagtcattaccgacatatagcatataggttaaaaataagacccagtttgcatcgccatggacagcagtcaatccccataatagtacttgagcaacgccctgaataagccacatggcaaaagcttctgaaaaacggaaagttgttaacagggcaccaacgaggccagttgccaagacagctgaatcagcaactggtcttggtgtgtgcaaaacctgtgtttcaaatagataagctgcaatgaaagcgacgattgctgagccgataagcacagggtaccaaaaagatttaccatgcttttcaccacgagcatcggtttcgtgtatgaaccgaatccgcttttcaacatcaattgcccagccaggcatgattaaaacgggaatatcaagtaatacaatatatacggcttgtaataccgcatcggcggggttattggcttggagtgccatcgcgatataaattaaagcagaaagtaaaccgaaaacgccatttaagggccgtgcattggtgatggccaatgttgttgtaaatcctaagattgcggcgacaaatgtccaccatgtcatatgattaatgggagaaccggcaaagaatgagctataggtaatgacgagataaccaaaaattaatagaatgtatgaggtccttgtccagccagacatctgatgaacgtaccacttgaatgaaaatagatctttaaatgtaattttttttgaagacatagcgtaacacttgcagtgataggtatccgttggatagcactgcacctttctgattgagattaaaagtgcgttgtattggggtttgtttgataaaacaactaccaatcagaatgaataaatacgatgttgctttcaataactcgtttattattttgaatcattttttctcctttttctatttaatttgagtgtacaacacaaaatttgacttgtgttgaaatttcaaactaaaagacaattgtcgtccatgttacaataatagtaagtgattgttagttaacaatttcgtataaaatagtttataaattgtttgtagaggttgggtatatatgaagaaacaagacataacaagtgttttagcgatacatgtcattgtattattattttttgggtttgttttactaacaccaacgcattttactttcctgaattggaacatttttttggcgttgttgccattagattttgccattattgtaaatattagtaaacgccgatccatacaaattattttcagcttgttatggctattattttatccaaatacgatgtatatgattaccgattttattcatctgcaatatattggtatcggactcactgttcgtatgcaatacttcaattacgcggtgttagcagcaggggtctttatgggcgttgttttggggatgttaagtatcgaactgattttaaagcattatttccatagaaggcatgaactattacaattggttctgatatttggcttgtcattgattgccagtgttggtatttatcttggccgttttttacgtttgaattcttgggatgttttcacacaaacacatcgcgtggcaaggttggtcgtgtcatcaactagtatgcatatgctggcgtttgttacactatttgctggcgtacagtttgccattctggtcatcagtcactttggtattagccttatccacaatgtagttgacaaaaatgaggaaacagagtaaactaatagatgttgaacaagtagaagcacccgcttctcgccaagtgactatgttgcttggcagatacagttgtacgaaagtactgcaagtgtggaagtgggtaaagattaagttcttggcccacttttcttcttgattcacaaaataaatttggaggtgcctgacaatagcacgtcaaccacgacaagttgatttagtcaacgaaaatatccgcgccccacgtgttttgcttatccacgatggtaagcaagaagaaatgtcaacacgtgacgcacaacagttagcgaatgatgcagacatggacttggtattggtgcaagctaatgcagaagttccagttgccaagatcatggattggggtaaagcgaagttcgaagctcaaaagaagcaaaaagaacaacgtaaaaaccaaaaaattgttcaagttaaagaagttcgcatgtcaccagtgattgattctggcgatttcgaaacacgtaagaaagcagcaattaagttcctgtcacaagggaataaggttaagcttaatttgcgtttccgtggtcgtatgattactcaccaagacattggtcgtgaggtcttagaccgcatggctgaagaacttaatgacatcgccaaggttgaacaacgtgccaaaatggacggccgccaaatgtttttggtcttggcaccacgcgatgccaagtaagttagtgtttagtagcttgctatagtaagcataaacaaaaatcgtaaagtaggagaattggtcacatgccaaagatgaagacacaccgcgcatcagcaaagcgctttaagaagacagccaatggtggcttgaagtcagcttcagcttatacttcacaccgtttccacggtaagacaaagaagcaacgtcgtcaattgcgtggtacacgcatgatggattcaacgactgtaaagacatacgctaagatgttgagcacgctctaatttcaaggtacgtctaattatttaatttctaggaggaaatacccatgcgagttaagggtggtacagtgtcacgcgcacgtcgtaaaaagtttgttaagttggccaagggttaccgtggacaacgtcgtattaattataaggttgctaagcaacaagtttacaagtcttacttgtacgcttaccgtgatcgtaagaacacaaagcgtaacttccgtaagttgtggattgctcgtatcaacgcagcagcacgcatgaacggtttgtcatactcaaagttgatgcacggtttgacattggcaggtgttgaattgaaccgtaagatgttggctgaaatcgctgtttctgactttgacacattcacaaagttagctgatcaagccaaagcagcattgtcatctgacaacgttttggttcaagcacgtacagcggctacaactgacacaactgtttcagttgaacgttaatcattaaactaaaaacgcttatagcgttttttattttgattaaaagttgacaaagtagataaaaattgttttaataatattatcaaataaatgagaaaataacatgacataccaatcagcaacaactgaacaaattattatcagcattattatcattagatagtgataagtgctgaaattttttagtgcctatcacaacataacgtgataggtagctgattgatattgttcaagagacgagctactagattcatagtaactcgtcttttttattttcttaataaaacagaggagaaaatgacaatgttgccattaaaagtatagcttgtttagctatagaaaataaaacatgaaatataggagagtaataatggttgagaaaaaattgacatggaaacaattagttttagtggcatcacttatatttgggatgttttttggggcgggaaatttgattttcccaatccaattgggacaattatcaggcggtaattggttaccggcgacaatcggtttcttgattaccggaacggttgtgccgtttttggcgatgatggcagtgagcttaacaaacagccaaagcgtttatgatattgctaaaccagtagcgccttggtttggtacagttttcttggtagctattcatttgacgataggcccattttttgggacaccgcgtacagcagcgacagctttttcaatgggtattgcgccttttgtaccacttagataccaaggcgtagttatgtttgtattttccgctgtgttctttggtttagcttacttcctaactgtcaaggaatcggggttattgaaatgggtcggaaaatatcttaatccacttttcctaggcttattactggtggtgcttgttttgtcattggttttgccaatgggggatacacatcaagcagtatctgctgcttatcaaagtaatgcagcattccaaggaattctggacggttacaatacgatggatggtattgcgctgttagctttggcggtatcagttgtgtacgcagtcagaggattaggctttcaaaagcaacaagtatctaaggtattggcaaaagctggtttgttaagcattctagctgaagcggtattatatgcggtattggttttggttggtactacaagcttaggtttgtttaaagtttctgataatggtggtgctgcctttgctcaaattgttagccactatatgggcaactttgggacggcgttgacaggggtaatcgtgacactagctgtatttacgacagcaatggggctgtttgtatcatttgcgcaagacttgcaccgtgtatttccaaaagtgagttacctatggtggctacgcgttattgcatttggatcattcgttacagctaatgctggattgacgaacattgttgcttggtcagtacctgtgttgatgttgctttatccatttgccttagtcttaatcttattatcgctttttagtaaatatttcaaaaaatctccagtagtttatcgttttgtagttgcctctgttactgtaccagctttccttgatgcattagctagttcaccattggctacaaccagccacgtccaaagcttagttaatggttatcaccactttgtaccgtttgcggcccttggatttggttgggttgtgccggcagttgttggtacggttcttggtgtgagtggttatttgttaaccaatagcaagcgcgttacagcactggattaaaattgatttgtttttagtatcagtttaaattatgagaaaattagccttgacgtcaatttttttggtatacttttatatagcaaaatgaattggaaggaaaggtgttcacggcttcactaaaaattagggaagtggtgtgcattcgaaaatatcatgggaaaatttgttgtaatggatcatcctttgatccaacataaacttacaatgattcgtaataagaatgttgggaccaaagattttcgtgcattagttgatgaaattgcgatgctaatgacgtatgaagcaagtcgtgatcttcaattggaagacgttgaagtggagacaccagttactaagacaatcaaaaagcaacttgctggtaaaaagcttgctgttgtgccaatcttacgtgccggactaggtatggttgatggtatcgtgcaactaattccagcggctaaaattgggcatattggtatgtatcgtgatgaagaaacgcttgaaccagttgagtatttcatcaagttaccagaagatattgaccaacgtgatgtcttgttagtggatccaatgttggctactggtggctcagcaaaagatgccatttcagcattgaagaagcgtggtgcaaagcatattaagttgattacacttgtttcagcaccggaaggcgttaaggcagtgcaagaagcccatccagatgttgacctttatacgggttctcttgatgaaggcttaaacgaacatggttacatcgtgccaggacttggcgatgccggtgatcgtttgtttggtacaatgtaaatcaatatcatcgtagtctgtctgtaaaggcaggcttttttattggtttcgtgacggaacttaagcaaatggcaagctattatgatacaataaacagcgattatgtaacgaagctaaaaggagcatttaattatgaaacgacgatctcagattcgtcctaaaaagcatcatagagtgcgcaatactattctgacaattattggtctattgtttgttgtcggacttggtctaggcgcctatgcatatactaaagttaaccacacaattacaaagatgcaaaagacgtcaacaacgacaaagtctgctgataaaattacaaatagtaaaaagccagtttcatatcttcttttaggaactgacacgggtgagcttggtcgttcgtataaagggcgtacggatactatgattgttatgacaatcaatcctaaaaccaaaacaacaacgatgacatcaatcccgcgtgatacattggtaacagttagcggacaacaaatgaaaatcaatgctgcctatgcatatggttcagctgcttcagcaacacaggctgttgaagacttgcttgatattgacatcaatggtggttatatattgattaacatgggtggtttagttaaaatggtcgacgcagttggcggtgttgatgtgacatcaccactcacattcacaactgaaggtgatgacacgcaagctgactctaagaaccagtattcattcgtatcgggtaaaacgtatcatatggatggtgaagaagccttagcctttgcacgtatgcgacacgaagaccctaatggtgattacggtcgtcaaatgcgtcaacaattggtcatcaaagccattttgaaaaattcagcccaagttgggactgtgttcaatgattctttcttgactaccgtttctaataatgtgcaaaccgacgtttcaactaagtccatgaaaaacttggcgttgagctatcgtgatgcatttggtacggttaagcaggatcagttaaagggtaccacgcaaagtatttcgggattggggtcaacagaagtcatgagccaaacagaaattgatcgtgttcataaggcaattacagcccaaatggcacaataaaagttaagtaaattttaggattgtccttgaaaactcttcgcagttttcggggactttttatttggcaacattatatgtataatgaaatagatattgaaaatgaaagaagtaactaatgatacagttaaaatcacctagagaaattgaagctatgcggcaatctggtgctatcatcgctggtatgcaccatatgttgcgtgatctcattgaaccaggtattgatacatgggaaattgaaacaaagtcgcgggaatatattgaaagccatggcggcgtgcctttgcagattggttttgaaggattcaagtatgctacgactatcagcataaatgatgaggtggcgcatggtctgccacgtaaaggactaaagctaaagaacggtgatttggtgaaggttgacacagtggttggcttgaatggcgccgtatctgattcagcatggtcttatgctgttggcgaggtaacaccagaggttcaaaaactgatggatgtaaccaaaaaggcgatgtatttgggtattgaccaagcgattgtgggaaatcgtgttggtgatattggaaatgctattgagcagtacactgaagttgaacaccattacggggatgtgcgtgaatatatcgggcacggtgttggaccaacaatgcatgaagagccaaatgtaccgcactatggtaaaccaggtcacggtgtgcgtttgcgtgaggggatggtcattaccatcgagccaatgattaacttaggtggctggaaggttgagactgaccatacagaagccgatggctggacagtacgaacagcagacggttcatggtcggcacaatacgaacatacattagcaattacaaaagatggtccgaagattttgacaagtcaggatccggagtatgataaacgttactcataattgtcatttttatgtaatgttttgtatgctacagtttaataatggggacaggggattttgctctttttgcgagcagtccctttttattatgggagaaaaatatgctgatagatttacatagtcacttattaccaaacatagatgatgggtccaagtctctgcgagcttctatacgtatggccaaggaagctgtagatagtgggattaaagctgcgttaatgacgcctcatcatatgaatggccattacgtgaaccataaagatgatgtcatcagactaacatcagaattccaaaagcacctagataataatgacattggactccaagtatttccttcgcaggaggtacgtatcaatggtggcttattgcaggctttggatgatgatgatattttgtttgctgacgaaagtaaccgctatcttctactggagtttccagatgatgatgtgcctacatatagtaaagatatgatttttcaaatcatgcaacgtggtattactgtagaaattgctcatcctgagcgaaatactaaaataatgtccacaccaagtattttgtttgatttgattgaagcaggtgcggtggcgcaggtgacagcaagttcttatgtaggtacctttggtaaaaaagttgagaagtttgctgaagaaattattaagcataacttggctcatgtttttgtttctgatgcgcatgacttaccaaatcgtgattatgagatggctgaggccatggcaaaattagagaaacaactgggacgggactatcaagaattgtttgagactaatgctgaagcaatacttgatggtgataatgtcacgagcttggttccagaaccaatcgttaaacgtaagttttttagtaaattttagagaatagagagattaatgaactatgaataatgttcttgaactacgtcaattatggcagattattcgaaaacacttcttttcaattgttgtgatggcaatcattggtgcagctgccgggtttggcattgctaagtttgtcattgcacctacctacagtgcctcaacaagcatgttggttaaccgatctgctgatgacacgagtaccgcaactgctaacttgtctgatcaacaggccgacgtgcaactgattaatacatataagaatttaattatttctagcaatgttctaggaactgtatcaaaagaattaaaaaatccagcaccaattgttgtacaagaggcccaagatgctgagtacaaaacgcttgctgatggtacacaacgtctagtaacgccagcaaaaaagagaattacaaagccttcaacgaagacaaaatataatctaaccgttgaagagctgaaagatatgatttctatcagtaaccaaactaattcgcaagtcttttcaattaatgtcaaagccaaaaatcctacgttagctgctgatgtggccaatgaagttgccgatgcgtttaaagataaaattggtggctttatgaaaattaataacgtctcgattgtcgatgcagcgaaagccaataaacaaccggttgcaccaaatgttaagttgtttactttggcaggattggttgtacttggtggattaacattcttgtatatgcttgttaaagaattatcggatacaaccattaagtcaccggatgaaatatcagaagcatttggtatgacaaaccttggtattattggtcatgttaagccaattaagcacttcagtatgtctcccaaggtagagattgctaagccagagagtcataaaacaccacgatcacgtttgagccgtttggatcgcgattaaagatgaggagagcagaatgagtttttttaataaaggacgagctgttggtaaagatggtctgtctgttgagacaatgaccaaaggcgctcgcttaattaccgcagcagaaccaaaaaatcccgtgtcagaacaattccgtaccttgcgtacgaatatcgaattcgcctcagtagcgaaaggtgaaatcaaaacgttattaatttcttcggcattaccttcagaaggtaagtcaaccgtgaccgctaacctagctgttgcctacgcgcaacaagggaagaaagtgttactagttgattctgaccttcgccgtcctacagtggctgtgacatttggattgaataaaaatgctagtgggctaacgaattatcttggtgattctgaaaaagaggttgggtcaattattcatcgcacggccatggataacctcaacgtcatgccttcaggaccaataccacctaacccagcggagctcctgggatcaggtcgtatgacgaacttaattacccagttgaaaacacactacgatatgattatttttgacgttccgccattcctgatggtaacagatgcacaagtgttgatgtcgaaaatggatggtgtagccattgttgttaatggtggtaaaacgactaaaggtgcgttacaacgaacacacgaaattttgaaaattgctgaagcaccagtacttggatttatttataacgatcagagtcgtaaaaagaagggcagtgctggttatggttatggctatggctatggctatggttatggagaaactaagggttaagtaataatcatatattgggagatgggagaaatatattggtttatagaaaatttgttaaacgattgcttgatttattacttgcaatccccatgttaatcattttattgattcctttaattattgttggaattattattaagctgacttcggaaggtccagttctatttattcaagaacggtacggtaggaattcgaagccttttgcgctgtataaatttcgttcaatgacaaacaaggcaccagtaaaagcaaattctgaatttgaagacattacaagctatgtgacgtcttttggtatgttcattcgaaaaacatcggtagatgaattaccacagttatggaatattattaagggcgacatgagctttatcggaccccgcccgctggctaagactgatgaaaaggtattgtctttgcgaaaaaagaacggtgccgatcaagtattacctggtatttcaggattagcacaagttaatgggcgaaataatctttctgatgaagataaggcagcttatgatgctaaatatgcagcacacttaagctttagagtagatatgttattgactgtggaaacgtttgtatctgtattgaaacgtgacggcgtatttaaagaaacagtgattgatgataataagtcagataaagatatggtgaggcatgacgaagaaagtattgatgttagcagcaaaggctaattgaccctacttactacaaataattgttcattaagtttatagttgtgagcaatacgtaactctttaaggagataataaataaattttgagatagtttatttatttaactataagcgataatgctgtacttttaatattaaataattgttttgatttgtaaaatttggggtaatgttaccagctaatttgaattttaaaagataaaaaatctgtgacaggttatttatatgatacagattgtttattctatgtcactacaaggagggaaatttgaacaaattcacagttttaatgtcagtttatgaaaaggatgatgcaaattactttattgaggccgttcaaagtaattttcaacagtctgtgaaaccgaaggaattaatcttagttgtggatgggtttataccgagacaattagaaacggcagttagtactgttaagaatcaatatcaaggtcaaattagggtcattcgtctcgaaaaaaatagtggtctaggacttgcacttagagaaggaatgaagcatattcagacaaacttagttgcaagggcagattcagatgatatttcggataagaataggtttgaaaaacaattattggaattttctcgtgaacctgacttggtcatagtgggcggtttagccaaagaatttgtgggcgatgtaagtaatattacatcttcaaggcgcttgcccaaaaatgatatagaaattagaaaattttcaaaattccgaagcccttttaatcatcctactgtcatgtttaaaaaggatgaaatattaaaagcgggaaattatcaaagttttaaatcctttgaagattatcatttatggatgcgagtactaaatttaggtggtcgagttaaaaatattgatgatgctgttgtgtttatgagaaccgacactggtatgtatggtagacgcggaggagtaacttatgctcttcgaaatttgaagttgagatggttcttcatgaagattggctcgatttctctctttgatatgttattggtagatattattctaattattaccgcattaattcctacctcctttaggtcagtattgtataagatttttctaagaaagaagtgaattattaaaatgttgaaacgaataataaaaagtaggtttgttcaatcgataaaaattgctaaggttatttatttacctttttatattaatactcaaaagaaattacaagttaaagttttgccaccacttgaaacagttaaacgtataaatgaagaaaaattatccataggacgttttggagatggcgaaatgagaataatgtttcaacagagagatataggctttcaaaagtttgatccaaaacttgcaaatgagttgttcgaatcagcaactccttccggtaagtatgtcattgcaataccgcatggatttgtgacgacaaaagatgataatttgagaactgctgttttttggtggaaatatgtttttgagaataaaaaacatattaggactttgaccgaccacgctaaaacgaaattattctttgatactaatttcagtagaacaaccacagagcttaaaaatacggatactgttgacaatgtgattagggaagttaaaaatatttggtcaaatcgttctgttattatgattgagggcaagcagactcgctttggaattggaaatgacttgtttgacaatgccttggtagttaggcgtgttgtgggacctgcagaaaatgcttatgacgctatagatagtttagaagaagttgttgtggaattgagcaaacagttgattgatccaatcgttttgatagcgcttggaccaacagctactgtcttgtcgcatagaatttttagtttagggctacaaacaattgatattggtcactttgatttacagtatgaatactatttaaagggatctcgccatcgagttaaggtttccggcaagtatgataatgaaaggggaactacgggacaggaggagaattttagtgatgagtcttataagaatcagatttataaaaaaattttatgaaaggagggaactgatgaatgataggtaaaataatctacacactgaaaagaaacacagctgttaaggataaattgaaattgttaattgcattgttgtattttccagtaatgttaagtgcgtacatattttcgaaaatcaaagggaacaaagggaatttatggctgataagtgagatgggtattgatgctaaagataacggacgagacttttttgaatatatccgcatcaaccatcccgaaattcaaacagcgtttattttaaaaaaaacagcgcttgaatataaaaatatcagtagtattggtcctgtaatagagcctggatcatttgagcattttgttgctgtcttcagatctgattttttaatatctactcatgatcattatgtcttaccaatgaaatgggttaattggcgggaatttaaagagttatatggttggatggttcctgacttaaagttcgtatttttgcaacatggtgttgaacaatggaatgctgaaaaaaattcaaactataatagaacgaaatttgattattttgttacaagcacacaatctgaatttgaagaagtttcaaagtatggatatccatttggtaatgttgttaaaacagggctgccaaggtttgataaattgaattccgttgataataaattattgcggaatagagaacgaataattttattttcaccaacatggcgtcaatatctagcaaatgtttcagataaagaattcttaagctctaattattttaaaacgattaattcaacattaaataatgaaaaggtgctggggttgttggataaatacagtattgatttacttttcatgccaccacatcatgaaattcaaaaatatcttcacgacttttcaggtgggtctgatcatgttaaattgatttctatagacgaccattcattaaaagaagtattaaaagacagttccctaattgttacagattattcaagtatttcaatggattttgcatatatgaataggccggtcatatactttcaatttgaccaagacgaatttagcaaggggcactatcaatatagcgatgactattttactcatgagcgtgacggattcggccctgttgttacaaatattgacgatttagtagctcatattagtaaagtgatagaaagaaattttgtaatgagtgactactacatagatagagttcaacatttttttgatctccgtgacaatgataactcacaaaggctatacaatattcttataggggaaagacatgattgaatttgtaacactggttgttacctatggtagtgaagatagagtgcagaatttagttaaaacaataaatagtgccctgaaacaaggaacacaaaaagttttcgtagttagtaatggtgtgcaatacgatatagcgaaagttttgagtatttttgaaaataaggtagatttaattaagtatgactttaatgtgggatctgctggtggatttggcggtggaattaaggaaattttaaaatctaaggaagttaacgatgagacatacatccttgtattggatgatgacgtcaaagtcgatgatgggttttcagaaaagttagaattattagaatcgaagttcagatggagtccacatatatggtctatgttaagaagaggacgtgattcaacattctctgctaattgggacagaagcatggaatcgtacaaaaattcaatagctggtttttcattgagaaataaatttttgctaccaaaaaaacaacgaaaaaatattgaagtagcggaaccaacgtttattacgtgggcaggtgtcgttgctcagaaaagtgtattaaaaaatgttgaattgccaaacgaagatttttttgtttatgaagacgatgctcaattttcattaaatgcacaacgtaaaggaattaaaattcgaaaaagtgaaaatttaacgttgtcagaaattggtgaatcgtggtttgaggataaaaaaagaaattctggatatagtattttttacaagagtgcaagtgatgaggggttaggtcgatttttatatatgcttagaaacaatgtctatttaattcgaaataacggattacttacaagtaatcttatatattttacgaacctagcgatttttgttacttttggttttattaggtacgggcatggaaccttccgttcgatgaaacgtttagttttggttatgagtgctatccatgacggatggagtggtcatttaggtcaaaacatcaattggaaattataaaatccattggagtaaagcttatgttatttgttttaacaatcatagtatcatttattgctagtctattatttaaaaacactcgaataattggtgcgctaggatttatatcattggcttggcttgctggaacagctgatgagagaacaaccaccgattatgcagtatacaaaatacattttaactctattggttatgaagtttcgccctttgagaagggatacacagtcatgtcagcatattttagccatataggatttgactatgcagaatttcgattgttgtttgtgttcctagcctttaccatactatttttcggtgtaacattgtttactaagaatgttgcaatgttcacttggatatatggaataacagttttttttaatgatgctacacaaacaagaaacttgatgatgatatctatggttatattgggaagtgctatatttcttaagttttcgttaattggaaaatgtctgggcatcttattaattctattttcatcacaatttcatgatttgggatttttatttattttaatcataccaatttttttaattaacgaaaaaattcttaaaaaaatagaagtttggataatcagtgtggcgggaataattttgatgtttgtgactatttttggaaattcaatacttcagaggatacttgtaaagtttttgacttcattttcttcacgtaatgattccgcaagtaatgttcaaaataatttttcaagaggaactagtatttctataattttacttatttggattactgtattattagtactttatttgtctaacaaattcatatcttctctgagcgagactcagaaaattagaatagatcagttgaaaatgttatatagtggtatttttatatccataatcactttattcttgattgttatgtcacctgactattctagaatatctagaaatgcatttttgttttttataattttagccactatatacataaccgatagtcaacccaaaagcaatttatttaagcatggaagaattttgtttgtactttcgttaattttagtaacttatacacatacaatgatatggggaccggattatcaaaattccatcgcttatatagcaaaactaaaaaattctaatattattagtggagattaagaatgacaaaatattctattgatgcagttattgtgacatataatccagatataagattgttactggataatgttaaagcaataataaatcaagttgacaaaatttttattgtggacaatggatcagataatttgaatcaatggaattctatcattaattcgtcaaatgtttcagtgtttcctcttcttgaaaataaagggatcgcctatgctcagaattttggaataaaaaagtccaaagagcagagttctgactgggtattaactttggatcaagatacaattttaccaacaagctatgttgtggaaataatgagaaatcattttccgggcaaagtaggaattatatctggaagatttattgatagatcatggaaagaaattaatagtatttacaatgagaagccaaatattgaagaagttaatgaaattatttcatccggaaatatagtaaatatatgtgcttgggaaaatgtcggtggctttgatgaaaaattgtttattgattatgttgattttgactttgattataaacttcatcgacaagagtacgcgatatatagagttaataatgttatatttgaacatgaaattggcaatggaatacctgaatcgatgataaaaacatttttaggattgaaaaaaaagcatgtttttgaccattcagcatacaggctatactatataaatcgaaatagaattatagtgagagccaagtttccagagtatggttctccatacagaatgatggtccgagaattaatcaatttgaaagaaattcttttatttgaaacacctaaagtcaataaattaaggttttctattaaggggatatttgcaggaatgtactacttgtttagtgggagatatttggatgaaaccaactaagaaatcacgagttttagccactaaaaaaaacgtcatgtttggtgttacttttcagttacttacattaatcatgacgtttgtaggtagatattttttcattcataaacttggtaattcttatttgggtctagatgggctatttaaaaatattctaagtatgttatcgttcacagaattaggtattggcgtagcaattacatcctctctttataagcccttagctgaatcagattacgtattagtgaaatcattagtatcattattaaaaaaaatatatttaataatggtgattattattattttttcgggtagcatcttgacgttatttcttcccttttttattaaaggtattgttcctgatgggacacgtattgcttttgtagtgtactttatgaattctgcagcgagttatttccttgtggccaatagatcgcttttgattgctgatcaaaatggatatctaaatgcatacaatcaatttgtgtttaatatggttgcgcaggtagctcaaattatcacattatttatttttaataattatgtagtttatttgcttgtgttacttatttcaacagttctttcaaatattacattaaacaggactgtcaaaaagaaatacccaatactcgataatgtacatcccagtccagttccaaaagaaataaaaaaagatttgttgcaaaatgttaccggaatgatttcttctaaattgggaggaattatattaaacagtacagataacttggttttatcctattttgtgggattaagtgttgtaggtatttactcaaattatttgatagttgtcaacggattaactactcttttaaatactggaatttctgctttaacggcttctattggtaatttaggtacagaaaaagacacaattaaggaagaaagaacattttatcaattgttcttagggaacagtttattaattcaaattatcagttttgcaatgattatttttctacctcactttatttctgtatgggtcggtagtgagtaccggctttctctttgtacgacttttgcaattgtttttttattcttcttgaaccagttacgtcagatttccatttcttttcagattgcgcattccctattttggcaacaacgttataaatcaatatttgaagcggtttcaaatctagtgatttctattatcttagttaagtatttccatttaggtgttctgggtgttgttttgggcactatttctagtaattttttagtaaactcttggtgggagccactgattgttttcaagtctgggttgaaagttggattgagacactattatttgctgttcataattgaaattattgctgagctgttattacttagtttgggcatgtatgtatcagtggctgttcattcaattattattaaaataataattttcacagctatgatgtgttttttaatcattattacctatttttccagtaaggattttaaaaactttatacataaaatttttcgaagttaagttattatactctgcttattaaaaaagtaataaatttaacatacttgctgactgtttgatactcttcctcgattaaatttctatgcacaatattagatcatatatatactgttttgttctagaaactattaatttttcaaagttctataattggtctttttaagtcaaaattaaacaataattacggataaatcgctatactaaataatagggataggttgttttttttgttttaagattatctgtgctaggagacttatgtcgaaacagcaatattcttgtctcttcataattgttttttatggtaattataactatttatcaatactatagctagttaattggaaatatggatacggagtaaggatttgattctaaaaattaatggtttgtttattaattatctatagtcaaatcataacttggctggattattgtagcaacagaaaatatgtgagaaactaagaatgaatcaagatgaatttaaagtatcagttgttatagcacattacaatgctggaaattatatcagaaaagcgctcgactctctggtcagacagacaatgaaccaagatgattttgaggtaattattgttgatgataagagtaccaagccattagatattattcaagaatatgagtctaaaattaagcatttgcgaatagttgtcgaagagcggaatcatggctatccaagcattccaagaaatcatgggatagcaaaagcacatgggacattcatcatgcttatggatcaagatgacaatttggcggatgacaccttgttgacttttgttgaatttgctggcgatgattctgatgtgattattggcaaatacgctgagggtaaaatgtacaacggcacacaagttccctttaagaacggcacgaacattaaaaacgcgagcattataacggatcatattctcagtacgttagcaccacataagatgtatcgacgggcgatgttaaatcaatatgatgttaggttccctgacagtagttacattccagtcgaagaggatcaagttttcaacatgaaagcctattctgtttcgaggaagatttctatcttagcggataaagattactattattggaatcaacgagaagactttggtaatctgggtaagagctcaagttatacctacaatgaaccttggaaatacctcaatatcttatcagaggtattcaatattattgaggcgtctcctaattggactttggcagagcaatctaggcttaaggcaatgtatattggtcgactatttaatagttcatataccactgtgatagaaattattaagcttcaaaaaaatgaacaagagagagagaagctaattgctggtttgagaaaaattatcaatgagcgtatggatgcacaaagtattaacgaagttcgccaagcatcgcgatggatggttctgggaattaagtatggtatgaacgatgaggaactatcgaacttagagacagaattgttttcaggtgagaaatcattagcgcagaacatacaatgcattaatggcgagacagtgaaaaatctgtcaatccatggacaattatgtgcaattccagttgactttttgaagaaagaaaagatacttggttcgaactaaattaacggacactattctttgatgtaaaatgcattagcatatataaggagagaaaaatgaagggcattatcctagccggaggttccggtacgagactttatccaatcaccaaggcaacaagtaagcagttggtgccaatttatgacaagccaatgatttattatccattgtccgttttgatgttagctggtattaaggatattttgctcatttcaacgcccgaatacgttggacgctttgaagaactatttggtaatggccatgaaattggtctaaatatcgaatatgcaattcaagaagagcctcgcggtttggccgatgcgttcattgttggtgctgactttatcggtgatgacgctgtggctctggtgctaggtgacaatattttctatggcgcagggttatcagagaagttacaagaagctgctctgaaaacatctggtgccacagtgttcggttatcaagtcaaggatccggaacgatttggtgtggttgaatttgacaaggatggcaaggctttgtccattgttgaaaaaccagaacagccaaaatccaattacgccgtaaccggtctttatttctatgacaatgatgtcgtggaaatcgctgccaatgttaaaccgtcagcgcgtggtgaaattgaaatttctgatattaaccaagcttatttagatcgtggtgatttagatgttcaagtcatgggacgtggttatgcgtggcttgacactggaacacacgactctctccttgaagcttcttcctttattgcaacgattcaaaaacaacaaaacttaaaagttgcttcattagaggagattgcttaccgtatggggtatatcgatattgctcaattagaaaaattggcgcaaccattaaaaaagaatgattacggtcaatatttgttaagaattgttgatgaagaaggggaataaggcgttaagatgactgaagaattttttgagaaaaaattggcagcacaaccaattacagctattccggggatgattgctttcgatattcctgttcacggtgataatcgtggttggtttaaggaaaacttccaaaaagaaaagatgttacctattggttttccagagtctttctttaaagagaacaagttgcaaaataacgtgtccttatcacgaaagggtgtgctacgtggcctgcatgctgaaccatgggataagtacatttctgtggctgataatggtcgtgtgttgggatcttgggttgacctacgcgaaggtgattcatttggacatgtctaccaaacggttattgatgccagtaagggcatttatgtaccacgtggtgtggctaatggattccaagtattgagtgaaacggtatcatactcatacttagtcaatgactactgggcacttgatttaaagccaaagtatgcctttgtgaattacgcagatcctgctttgggcattgaatggcatgatgtcgaaaatgctgaagtaagtgaagcagacaaaaatcatcctttgctaaaagatgtcgtgccactaacaaaagagcaattgtaataggagaacattcatgactgaatataagaatattttagtaacgggtggtgccggcttcatcggggcgaactttgtccgttacattgtcgaagaacatcctgatgtttttgtgacagttttagataaattaacttatgctggtaacagggaaaacttagcaggtttgcctgaagaccgcgtgaaattagtggttggcgacattgctgatgcaccattggttgatcaattagtatctgaaacagatgccgtgatccactatgccgctgagagtcataacgataattcattaaaagacccatccccgtttgtacagacaaacattattggtacatataccttaattgaagcagcacgcaagtataataagcgtttccaccatgtatcaactgacgaagtttatggcgacttgccattgcgtgaagatttgccagggcatggtgaaggggccggtgaaaagttcacaccagaatcacaataccgtccttcaagcccttattcatcaacaaaggctagttctgatttgttagttcgtgcttgggtacgttcgtttggcttgccagctactatctccaacacatcaaacaactacggcccataccaacacattgaaaaattcattcctcgtcaagtgacgaatattatcagtgggattaaaccaaagttgtatggaaacggtaaaaacgtccgtgattggattcatacatacgaccatgcgactgcagtttgggcaattttgacaaagggaaaaattggcgaaacttacttggttggtgctgatggtgaaaaagacaacatcacggtattgcgcgctattttgaaagatatgggtaaagctgaagatgacttcgactttgttcaagatcgttcaggccacgatttacgttatgcaattgatgccacaaaaattcgcgaagagttgggttggacaccaaagtatactgattttgaaactggcctagctgataccattcagtggtacaaagacaatcaatcttggtggcaagctgaaaaagatgaagttgaagccaagtacgcacaaaataatcaataaagttaaaactcacgcatgtgagttttttgtctatgagggagaattggaatgaaatttttaattacaggtgctaagggtcaattagggcaagaattacaaaagttattgcgcgaacgtggactagattttgtcgcttttgattcaaaacagctcgacattacgaacagcgcagctgtgttatcagcatttgaacaagagcaaccggatgttgttttgcacgtggcggcgtacacaaaagttgatctagccgaagatgacgggcgcgagttaaactggcaggttaacgttgatgggactaaaaatgttgccgatgctgctaagttatacgaggcgaagctggtagccgtttcaacagattatgtttttgatggcaccaacgagggcgaatacctcgaatcagatgcggttaacccgcaaaattcttacggacgagctaaactagccggtgaattggccgttactgaaagtggcgctgatgcctacattgttcgcacaagttgggtatttggcgagtttggtaataacttcgtttacaccatgcaacgcttggcagccacgcaccccaagttgacagttgtgaatgatcaactgggacggccaacttggacacgtactttggctgagtttatgcttcatttggtagatactaaggccgcctatggtatttatcatttgtctaacgacgatattgccacgtggtttgactttgctcgggaaattttgaaagatacagacgttgaagttgccccagtaactagcgcagaatttccacaaaaagcttaccgaccaaagcattcagtgatgagtttgaagaaggctagggcgacaggatttgagattagtacttggcgcgaggcactgggggagtttttggcagggataaagtagtagtagttaaattcatgctgatgagataaaaatatagtttggaaagaagccttatcttatatggagtaaggttttttgtttgctattttacttgtgaaaataatatttaataacatacattttacaataagtcaagcaaaacgactcgaaatacgtcgggttgaaattgtcattcgttctaatttaatatgcaagtacttacttgtattaaagctattgatacaaaatattctaaacaaaaatcgttaagatagtaattaactaaagtataaatattattgtgaattaataaacgattataaaaaaacatatttctgttgttttgatttcacattgtaactggtacaatgataagcgtttgagtgtattagaaaggaggaattcatgttaaaaaaagcactattagctctattgggaatgttaactgtagcgattgtgagtgcatggtatattaatttttcacctcaaagaacgtcagtatcaaccacatatcaatacaagaaatcatcaagtacatatcaatttcaaagacttgcagaagacgatactagggtcactttgccagcagcaggtcactggcaagatgatttttcagaattaacgaatactgtattgggattatctggtcaattcaatattttttcaaaaacaatggaccttgatgatcgaccaatagaaggtaattttgctacacaagacatgattagaaaaggtggcagttcagctggtcataaggggatttcctatcttcaaagaagcatacagtctaataatgatcaggcaacatttaataacgatactttaattttaggctcgtcttttaaatatttacagccaacagcaaccgatggacgatcaacaatcaacggcttaaaattaaaccaaacaccaaaagtattacggcaagatactgataataatgaatatttggatatagatacagaactcgcgaggctatcatctgtatcaaaaataatcgccaaccactccaaaaataataatgccactgttgaaaacaagtggggtggtacgataacaattgatgcgagtcatattccatcggaagataatgtcgagtatttaactgttaaagcaagtgattttcctggctattctttgtcaattaagggaatatctgatgtggagaaggtcgttattacaatcgatacttccggtgtgaacaatttttcaacaggtagcatggcttttgattcggtttcgaaaagcaaaaatatcatgtttaatttttataatatagattctgaaactaattatacaggtaatgttgattggcagagcaataataaagaaacaagtaatgccatattatcgcctgaaggcattgtcacactgtctggtattggtacgtttaatggtaacattgttgcacataaatacgtaggaaataacacttttccaacaagtagtacttttccagatttggaactgccaattgatagaaacaatggtgtgtcaccaaagttaatctctgctccagatgtagattttggttctcacaagatgaatagtgaaacaagtttgattggtaattggaaaggtaactgtcaagtcagtggtgaaaaaggtaaagaaataaaaattaacgttgaattggctaaacagttcacatcagaaaatggatcattcgctaatgatgttagttggcagttagtgaagagtgattacagctcgggcagcttaacaacgtctttacaagactttacaacaacatcggcacgtattaattattggccctggcaagatgatgggactggtaatttattgtctgattggagctataacaaagaaaagaaacaatatagtttctacgatatgcaagtatctaatttagacacaataacagaaataggtaattatactgcaacgctgagatggacattggttgatagtccatgagagtctacatgaaactaaaaagattctgttgtgtgtcttatccagctacgtaattgctagttctatgactgtttgttcggctaatgttgggatctgcaattgaatctcacgcgcaaataagttttcaaatacctgactatatacctgttgagcaacagccaaccaatcaaatgtccacagctaaaggtacattagtgaatgcaccaatggctcatggtaaatttggccgtcagtttggttatgtctcaactcgaaaggaggtgataccggtcattacacgactaccaagtgtagctgtaacacataggcaatcattatcatacatattatgcagtgttatcatcattacgatggtgattatttcagagaataagagaacagaaaaagggaagaattatgattaacaagaaaattttaggactagcaggattagcaagtttgggattagcaacaacagcaccactcgctgtggtacatgcggagacagcttcagaaataaaatcaaaagcaacaattacatttaaggaaaatacagaaggcgaaaactctgtattaaatccaaataatccaattaatgaagatggcagtaagaatattattactcctgatgattcgactgaggcgactgggacaacgcttagaattgattatgcctcatcatttaattttgataatggtaacgagtctaataaaatatcaacatcgacacaaaaatataaagcaactcttccaacatatagtggtcaagagagccctaattttgttcaagtaactgatgcccgatcaggtgatgctaaaggttggaagctaagtgttcaacaaatgggacagtttaaaaatggcgatagtgagttaaagggtgcaactattactattaatgatgggacttatgcttctggaaacgaatctggatttgacaactcaacaaatccagagacttcaacaaatcctgtgacaataagtttgcatgagggaacacccctcatgactgctaaagcaggtcaaggccgaggtacttcgttatatacaatgaagaatgttgaattatcggtccctggttctactgttaaagaagcaggaacatatacaacaacacttaaatgaacattatctgatacagctgtagaataatggttaactttttcaagaggacattaatatgatagttaaaaaaatttacggattttcattggcagtgttcatagcaatgttttctttttttgtatttaataacacagcaattgctgctgaaatgaatttttcagtaaacaccgttgttcccgataatcaaattgataagtcaaagacatatttcaatctgaaaatgaattcgaatcaacagcaagatattatggttacgttgaaaaatgatacaaaaaaagatatcactgttgaagttggcgtcaatactgccaaaacaaattccaatggggttgtcgaatatggtaaatccagtataaaaaatgacagctctttgaaatatgacatttcaaatattgtcaagggtccgtcaagtgttgtaatccccgccagctcgtctaaaaatgttgctttccatattactatgcctaaagaatcatttgatggtatattactcggtggtttgacatttcaacaaaaatcaagcgaagtaaatcaagataaagccaaaaacggcacaacggttcaaaatgaatactcatatgcggtggctatcttattaaaggaaaccgataaagtggttgatcctaatcttaatttacttcaagtcaatcctggacaaataaattatcgcaatgtcattaacgccgaacttcaaaatgatcaatcggtcttgatgtctaaagtatcagttgatgccaagatttattctaaaaatggtaagaaaccagtatacacatcgattaaaagtgatatgcaaattgcgccaaatagtcatttgacttatcctatttcattaaatggtacgtcaatgaaggctggtgactatacgctgaaaatgaaagttacagctacagctaataagcaagtcaaaaaatggacattcactaaagatttcacgattaaatcaaaacaagcacgagatttaaacaaatcagatgttgatgtaaaagcgaatactaataatagtaattggctgtacattttgataggtgctgcattgttaatcataatcattattttgattgtcgtgattattttacagcgcaagaaaaattctaatcagtaaccaaaaagcagaaacaccattcgtttctgctttttttcaacttttaattagaatattttattggtactataataaaaaaggcacgatacaattcggcgacatttaaggaaatagtgagtgcaatgttgaaaacagctaatttaagaaaaattgcttcaaatatagagtctgaaagcatcaaacattatctaaatgatttaggtgtgctatctattcgtgaaagagaactacaagggattgagcgattagtgcgtcattttattgatgagcaggtacccttaaattttttttatattggttacagtatgccaaaaattagtaaggagttcgatttattagcctttgatcaaaggcatcgtgtagttaatattgagctcaaaagccaagctgattatgatgaagagaaggtcagaaaacagttaatcaacaataaatactatttgtcacaagttgctaaagaaattaaactatttacttataactcagattcagacattatctacacattaactgaacaagatgaactagaggcaacagatgtatcatcaacgcatttgtttttggcatcagaattttatcggatactggcaactttcgatagtatagatgtgggcaatttagatagcttgtttaaggtcaatttatatttagtttcgccgtttcgagaaacacatgcttttttagagggggactatcttctgagtcaacagcaacaagtacttcagaacaatattttaacaataagtgagtcaggtttctatgctgttaatgtaccatctgggaatggaaaagcactgatgctgtacgatactgttaaaaaattgagcaaaaataatactgtcttaattgttcatgttgggaaattaaatgccactcaatctagcttgagacgaaattatgactggaaaatcattccaattcgccagttcatgaagaagataaagtcgaagaagttacaaaactttgattacatttttattgacgaagcgcagaatctatcaattaaaaatatcaattctttggttaactatttcgaaatgcaacccaccaggttatttttaattggtgctaccagttcaaataccaaaaaaaatattgataatgactacagctttttgacaattgggtaacagctgccgtcaacctattgtaaattagcaggcattatgtcaaaatgagtacttaaggttagaacattgctaattgtttttttacttatgggagagaagtgttaatgaaaaaaatatttggtatcattgccgctgtcattgttgttattgtggggataatagccttagggcatcaaaataatgattcttcgaaaacatcaaaatcgtcaacaacagttaaagtatcgaaaagttcatcgaagacttcgaaaagtagttcagttgaaaaatcatcttcatcaagttcttcatctgttagttcttcctctgagcaaacgacatcatctagttcatcagaaaactcgtcaagttcagagtcgtcatcttcagatagttcatcatcttctagttctgtaagttctaatacaacggatagcccaacctatgatccaaacaaaaccgttcaaggcgttgaagtgacatcagaaatgattgctgaaacacgtaagcaacttattgcggcgggattaccagcggatcaatgggcaccaagcgatatcaagaaaattatcactgaagcttctcaacaaaacatgtcagttgttgattacgcaaaggctaattttcataattaaaaaaattgctgacatcggtcagtgtacatatgtgggagtgtgtaaatgaataaaataactttttggtcgagcatcgcagcggtgagcattgctgcttcattagtagctgttggtcaggctcatgcagctgatggtgtacctgctatcacagcaggtacttctggcttacctagaatggatgttgtggatgtttcctctaacaatggaactatttctgtagctgattataagaagatgcaaaattatggtgttaaagccgtaattgtgaaactttcagaagccgattcatataaaaatccatatgctaaatcgcagattactaatgctaaagaagctggcctacaagttggagcatatcactattcatggtacgcttcaaaagctgacgcgcaagctgaagcaaagtattttactaattacgcagcctcattagaactaccaaaagatacgttgatggttgatgatttggaagaatcatacacaaaaaatagcagtgtaactgccaatgcaacagcctttaacgcgcaagttaaagctgctggatatacaaatacttctacttatacatatgtttcttatgttaatgaaacgaacttgaatttttcatatataggtaataatcgggtatggatggcacaatatccataccagccaagcgctagttctttatggaatcaatcatatggtatgtggcaatggaacagtaatactagttttcctggcgtaaaaggaacatttgatgtttcgattgattatcaaaacttaatttcgattaacgccaatggctacaataatggcattttctatcaaaatggaaagccggccagcggatatatttactcaccatcacaatcaactgccaatggtggttataactggtttgaaaatggcaaaccatacactggtttccgctattacatgggcacttattattggtttatcaatggtgtacgtcagaatgccggttggcgtgaagcttggggcatgaagtattacactgataatactggtcgtgccttacagggcattcaaattattgatgggcaagcttatgactttggtacaaatggcacctataatttgaaggggatggctagtggatacttgtactcaccatcttactcaactgccaacggtggctataactggtttgaaaacgggaaaccatacactggcttccgctattatacgggtacttactattggtttgtgaacggtgttcgtcaaaatgagggttggcgacatgcatggggttacacatactggacagatagcacgggtcgtgctgttcagggacatcaaaaaattgatggtaaagactattactttggtgataatggcacatattacatgcgctaattcatgagggcgaaagccttttttattgcaaaaaattaaaaaaatattgagagtaaaaatatgaagcgttattattacatggatattctgacaatacttgctacgatagcagttgttttccttcatacctcagaatatgctttttcaaatcaaactggtgattcgcactggattatagcggtaatacttcaagttacctttatttgggcagtgccaatcttttttatgatgtctggtgcccatttgctagattatcgcgaacgatatgatacagtaacttttttcaaaaaaagaatgaccaaggtttttgtgccatttattttttggtcatttgtgtggtatatcttaaatccatttatatttcatcaaccaactgattatcatatcggtcaatttatcgatgcagttatgcacaatagtatccagccgatattttggttcttttattttgtcattggtttctatatcagtgcaccactgttagctaaaattacgaataaagctgataaaacactagccttatatttattagcagtgaatatgatctttgtcaatatcttaagttactactatgaagttcgtttacaaacagataatttttttctacatggcatacaaataggtgctgctggtggcgttggctttttcgtggttggttggtacttaaaaaatactgttttacacaaatggcaaaaaaatatgctatatgtggctgccttagcatcagtagccatcatgattgcgttgacaatttacctctccatcaaaagaggcaaatttgcacgcgaagtctatgatatttggggattatttggatttatactctccatcggcgtatttgaatttgttaaaagtcatttggcgacatatcaaccgagtcctaaagtgcaacttgctttgcaaaaagtagccagtacatcgcttggtgtgtatgtgattcatgaattcttcatttactttgctgagagaaagttacatattgccgacagttcgctaaaacacatgatcattttgccgatcattgtatggttagcatcaactgctcttgtactaattattcataaaattccattgctaaataaaattgtatagattaaataaaaaaagacgtatacggcgtctttttttatttatgatatacgcttaacaagcgaatgtaatactattgaaatgataagcgtttatacttaacaaagatatattataagtagtataaagtggagagttcatatgagaaaaaagttatataaggctgggaaattatgggtagccggagctgcagttgcagctgcagtcgtggtagcacccaacattgttagtgcggatactacgaacagtacaactactgcagatgcgactacaacatctagcgcaaccgaatcgagtatttcctctacggaatcagatgacaacaaggtagatactagtaacactgatgcggtcactgttacaactaatagtgatgatagcaattctaactcagcagagacatcaaacagcgatgctaaggttactagtaacaatactgctcagaaggatgaggaaataaaagctgaaaccacaaataatcaagatacaacatcaactaccgcagtagctgaaacaaaaacagcagttaatacgtctgaatcagaaagtggcagtaataacgaacagttggctgaaactgctacagataatgcagaagtaaatgatgcgtctagtcagaagcaatcaactccatctgtagaaaaactagatgatagtgtttcaaaatatttgaattcaaaaacaaccgttgtcactaaaaatgctgatggtacgtcaacaactaacatgacttatgctaatttaaaggatgttgctgacaatattgctagtttaaatccagacacatctgttccttattttaatgctgatgcgattaaaaatttgccagcaatgacaacggcagatgcacagactggtcaaattcaagacttggatgtttgggattcttgggcgttacaagatgcaaaaacaggtgctgttgcaaattatcatggctataatatcgtgtttgcccttgctggttatcctaaagaagataacgatcaacatatttatatgctctacactaagtatggtgatacagcattaaataattggaaaaatgctggccctgtttttggtttcgatgcgaaatggaatgagcaacaatggtctggatctgcaacggtcaatgatgatgacagtattcaattgttctacacaaaaacagatcaaccgatgactgttcaaagactagcaacagcaaacttatcaatgtcttatgatgatttagaattgaatgttgccaaagtcaataatgattacgttattttcgaaggggatggagaaaattatcaaactttcgagcagtgggataaaggcggtaattatgcgacaggcgataatttcacactgcgtgatcctcatgttatcgaagtaaacggagaacgctacttagctttcgaagctaataccggtacaaacaattatcaaagtgatgatgccgtaaatgacgatacatattatggcggaacagaagaatttaatcaacaagccaaagttgatacactacagaacccagataaactgaaactatcaaaaaaggctaatggtgcgattggcctgattaaattgactaaagatcaaaataatcctacagttgctcaagtttactcaccacttctagcagctgccgcttcgtaagaaacaactcctataactatactcgctttattaaaaaagtcaacctttttttcaattttcttcaaaactgacaaataatgtggtttttaaggtttttaagagctcatgaatcttattggccggcatgaatttaagtttaaaatttaattcttgttcaatcttctcagtatcttttacctcaaaagaatagattgataacaactcaccctcaacttccacgctagtcaattcaccaagacgccaatcatcaaaatttactgcccccaactcttttaaaccgcgtagtgctgctcccaaggatgtatcattattgtgtttatgcatctttgtagtgaagaactggtagccattttcttttttttgtaccaaaaaataaggtagattatctttcactgcaattgctgtaactgctatcaacgacatatttactcactttccgagacgctcaagtgcctcttcaatccattcattctgtttattagcaatagatgtaaagccgtattctaaatgatagtttgtccaaaaacgttttttaaaattgtggtttttgcccatcatttttttgttagtgtttatcatttcatcttgacgcaatgataaacttattttgccattatactgttcaatatccataattacgatattgacttctttgcccacttttaattcaccattcaaatcacggacaataccagatttacattccgaaatatgaattaatccttgtgtgtgatcgtctaatgatacgaatgccccatatggttgaatccctgttatgcgtccttttagtttttgacctacagaatacttcattattttgcctctatgtttcattatatcatggtctcttagttgttcgttcttttgaacaataaaaaaagcaggttatgcacctgctatctcaatcgtattgataactacgtctacacgtggcttatccgccatatcaacttttactttcgctatttcatcgacaatatttaatccttcaatcacttgaccaaacacggtatgtttgccatcaagccatggtgtaccacctttttgtcgataaaaatcagctacctctgccggtaaatcacgcaatgccgaaaccatttgtgatggaaaattagatgcctgtacaataaagaactgcgatccattcgtattaggaccagcgttagccatcgaaagagccccatacgtattaaacaaacgatcgctaaactcatcttcaaaactgccgccccaaatactttcaccgcccataccggttccttcaggatcgccaccttgaatcataaagtcactgatcacacgatgaaaaatgccattgttgtaatatccattttttgcatgtgtgatgaaattttcgacagtttttggcgcaatatcagaaaacaatttaattctaatatcacccttatttgttttaaaaattgcaacagggccactataattagcagcgtctaattgtggataatctaccatgaattttctcctaaaattataaaaaacgcctagtggcgtttatacttcgtcttcaaatttgggatcaataatgacagcgccattttcaatttcttctaacgcttgcccaacagacttattcgattcaaatgtttcttgagttgctggtaaaccagcatccaattcacgagcacgctttgcgcctaaagcaattagcttatagcgtgagtcaactttttctaatagcttatcaactgatggatatagtaacatgtctctctccttattgtatcttatcaaatacacgcgttacgcgtaggcgttctgctgtaatgattgatttgattcgttcaactgcgtttgaaaccacatcgttttcaacagcataatcgtaattaatcatcattttaagttcgtcacgcgccgctgcaactcgtttttcaatcacatcagcagaatctgtaccacggccgaccaaacggtcgcgtagatttgccaaatccggaagtgtcaaaaatatgtaaataccttctggcatttttgatttaacttgcaaggcaccttgtacgtctatttccaaaaaaacatcacgcccgctcgccaacgtctcgtctataaagcttttaggtgttccgtaatagttgctgacatattttgcatactctaacatgtcaccattattaattttttcttcaaactgttcacgggttacaaagaaataatcttcaccgtctacttctccagcacggggctgacgtgttgtagcggaaatcgaatattgaaaatcaatgctttcttcttcaaaaattgctttacgtacagtgccttttccgacacctgagggtcctgaaagtacgattaataaaccacgctgagtcataatattcctctttataaactaataagaatattatagcaatgtacagccacaatatcaatgttaacataaatacagccactgtagtgaatatttgttcgtatagacaaatatagactttataaacagaatatgcctatttatcaacataatgatcataataatattcaagaaacgtttaagaaactttccatgatttgcttatttgaacatttgttcgtataataaatttatacaataacgagtggagaagactggtatgcaaaattatattgtccaacatcaatttcaagcaccattacatcatttacttcaaaaacttattaaatacgttgcttcaaaaaaagcagtgcctttaaagcgccaattaaatgcacaggaaatcattgtacgattagaactagcgctaaatacaactgatcctgtaaccgttcagctcaatgattctttgttcaatgagcgcattacgcagttgtctggatacatttaccaaaataatcatggccagctttttgtgcaatcctataagactcataagttctctaatataacaccaggaatgattcgacacatttcatttaattgactgtcaaccaaccatatgtgtacgtaaaaaagcacaatcatagttgtgctttaactaagtttctctatatctttcatatctaacttttcaagtaaagaattaatcgcaattacatcaatataacgatcaatatcaagagtccctgctacaaggtcacctaatcctgtgagggcttttttactactcaaaaaagttaaataagatttgacctcaccaccaatgccatctaaatcacgccattgtggtgtccaataatctaacagatgtttttcagcaaatgcatttaacaaatttgctcgccataatttgtgagttgcattaaactcgcgtgccattccctcgtgaaaggcatgaagcatattaatgacattatcactgacaacatctttaacagaagcttcttggaacttttgtagacttttatcagcaaattcaatttctgtttgcatttcgtctggtgacaacgatggttgcaatttttgcacatcatcagtattcttcaaaggcttcattttaggtgatagtccgcggaatgtttcattaataatttcaagattaaagtcatcatcatcttcactttctgacaaaaacttaaattgcagttcatcaatggcgtttgacgttttcatcatttccgcaacatctttaccttgccacttgaaaaaattaatcgcgattaccgtgcgcataatcatacgccaaaaattaatatcaaattttggtgcgtgagcgataaatctcttgttaacactactttcttttaccaagaattgttgcatatcatacaagacgggtaccaacagtacaaagtaacgccaatcacgatcatcgctattcactaatgctgcttgcataacctcgttcaaattaactgtggcccgttcgttgctagtaaattttgtaaaattttgttgcacaatcgtagcaatcacgtcatccaagaaaaaagaagctacttcaaatgtttctgtagaatatttagtattgtatgtcaaataatatcgtgcacgcaaaaagcccgcaaaatcattgtagttaaattctggcaatacactttttgaagtgaatttctgctttgattttatatgacgcattttttttatttgcgctgatttcccttgtttcatatcataaaagtatcaaattaaatcacttataattcgtgatccgcattcaacacatcctcctttttaaatactcaaatctagattgtacttcccactaccaaactcgcgtaacttgaactgaaatacttgctcgttacgctctaaattaggtgtgacaacggttgcctgttgtttgccctctaattcggcaatttcaattgcactattaatagctgacatcactggggcaaattcctttggatccgcagacacataaaacatttctgcattcccgtatgttgctgacctgcgcatcaaactaactgagaccctatatctgtttgcatcaaaaataatatgattaaagttaaatccgtgcgcataatgaaataatgatgataaaaattcttgagagttaaatttttcttttgccatgtgttttccttaaaatagtttcaatacaagtatactataaaaaatcaatcaaattgaacaatcaatgttcgtcgtattaatcccaatttattacccgttcttacgaaagaagaaggctttcgacgagaaagccttcttcttaatcaatagttaaattacttcaattccacaatcgttgcaccgtcaccacctgcatttgcactagcaaaatgatacgacttcacgcgacgatcagatctcaaaaactcggtaacaccttgacgcaacgcacctgtgccttttccatgtataatttcaacaggactaatgtttgctaatactgccgtatctaaatatcgatctagctcggttaaagcagcttcataacgtacaccacgcaagtccaatgacgattttacagaagcccgcgttgatccactgcttgttgtttttcgaataattttttgttgtttcttcttagctttacctttttgagccttcacagttgcttcagttttaacaatatcgtcttcatcaacaagcatttttaaaatgcccatctccacttcccattgaccattcttgtgctttttgactaaagtaccctgctggctgtaagaacggacggtaatttcatccccaggggctaattcttttaccttttttgctttttgcaaaattttatttttttccaaagagtcattctgccgtaactgatctagctttccttttctggcttgcagttcttgctcagttaactcaccacgctgtcctgctcttaaacgcgctttacgaatttcactaatcaattgctctgcctgttttttggttgctgcgacaatatgattagcttcatttttagcgtctaaaataacatgcgcgcgctctttttccaacttactttgttcttcgcttaaggcttctgacttttcttccgtcgcctttagttgtgatctaagttcttcattattttttttgacttcatctcgctgtgcaaccaaatcagcaatcatattattcaagtcttgatccgattcgtcagtcaaagccatcgctgcatcaatgacatcttcaccaaatcctaaacgcttcgcaattgctaaagcattagattgtcctggcacacccatcaagaattgataagttggttgtaatgtttccacatcaaacaccatggaagcgtttttagtttctggtcgattataaccgtataacttcaactcaggatagtgtgtcgtagctatcgtatacgcccctaggctagcaactttgtctaatatagcaattgctagtgccgccccttctgctgggtcagttccagcgcccagttcatcgaaaataactaatgttttattatcaatgtggtcaagcattgacacaatgttggccatgtgagagctgaaggtagacaagttttgttcaattgattgttcatcaccaatatctgcaaaaacttcatcaaaaatacctaccgtagagggttgccttgtcgttataaataatccagattgagccattaattgtaatagcccaagcgttttaatcgtgatcgttttaccaccagtgttaggaccagtaataatgatagttttgtagctatccccaaggcttatatcgttagctactgcaatttttttatccagcagtggatgccaagcttgtcgcaagctaatgtggttctctacgctgacagttggttgcatagcatctaagcgggctgctaaccgcgctttggcattaacaaagtcaaagtgccctaaaatttgaacattttgttgaatctcatttgtatgtggctctaattctgctgatagttcttgcaacactctctgctcttctgcattttctttcacgcgaagctcgcttagtttgttactcaattcaacaacagcttgtggttcaatataaagtgtcaatcctgtttgactttgatcatgaacaacaccaccaaattgacttctatactctgcttttactggtaaaacataccgatcacttcgaatagtaacaatcggatcattcaaatattgtgcagttttgcctttagtaaattcctgcatcttatttttaatggcattttcgtgaccgactattttgcctcgaactgattttaactcatatgatgcttcatcattaatacgaccagttgagtcaatagcagtttgaattgatttggtaacctcaggcaacgtttctaattgctcagcttgttcaataagcacttctaaagattcaccaattgactcatctttcatctgtatgaaaaaattagaaatagcacttgtattacgtaaaacatttcctatttcagctaattcagtagcacttaaacttgcttggatatttagtcttttcaaatgcggtgtgatatcggctaatttagctagcgggatgccgcctttcaaacgatcaatcatcatcgcatctgctgtttcttggagccaataattaattatatgtacatcagtaattggctgcagcgcgtctgcttcttgtcgtccaatgggcgttgataaaaaatcactcagttgtgacttgattttgtcatattctaatgtttgtagtactttttgattcattttatcttcccaaatatctagaacaaaaatgttactagattctgttctatgtcagattctatagccaccaattatatatttgattagcaaaaaatggcatattgtctaatatatcgtttaatagcggcgtttttaagaattggtcttggatccagacgttaggcattacagacagtagttctagggcaaaaaatgctataacagcgcccatgataccatacagcagaccaccgaggatcgcgtcaaaccatcccaataatggaatgtgtcggacaacgctaaaagattttaatatccagtgactaacaatgccacccaggatgaatattattgtaaatactaatcctgatgctaaaaattgtgaaccgtcaccaacaacactctgtggtattgtcgttcgcacaaattgccccgagacaaaatcagttaatagctgtccaaacggcttagaaaatttaatggcaatataccaaacaattacccacaatataaaacgaagcaccgcattgactaatcccatgcgataacccattctaatagtaattaaaataaaaagtattgccaatcctaataaaatcatttgtcagtttccttaaatattttgtttgatgcgcgcgtacggctttcttgcttagctgtagcgataatacttgaaacggcactttttttaggcttcagcctttctttttgcgattgtagcaaattaatttctgcttgcatttcagctattttttcacgtaattcatcaatttctgcttgtttatacaactgatcagatattgaattgaatgtcaaaagaatcgcctgatccaattgtgacaactttggagcaacaactttaatttgcttaatctgtttattaagtaattcctctgttgatttaaaatgaggcagactcgcttccccagaaataacatatgttttaccggcaatagttgccttgtattgtcttctttgttgttttgtcatactttaattatacaataaatcccataattgcgcggaaaaactaccaacaccgttagtttagttaatgagcactggagaaactggagactatcctttcatttcatgaattatttaatatcggcgctcacaacatagaaattatctctaatttttacactacgattaagttttaccgtaattatatctccaactttaaatatcctatcaatatgattattatcaactaaaatgctaacctttttattattattttctggcaaattcaaaagtattgaatcccctttaatcactttatcattaattttaaattggaggattttatcagacacatcagttttatgaagaacctgataaaatttcctttcatcatctttattcaccactgtgtaatctgcccccgtcgtgaactcccacaacagaatagctaccccaccaaaaactactactattattatggctattaatagtgacttagtttttaacatactttattttctccccatgtgactataattcaacagcaataacccatactgcgattatataatattaacatatctcaaactgattttgagaatgttatcactaacaagtagaaaaccaataataataagatgaatttttttctaaacacacagtgcaaaaaactgctatactgctaatatgcaaaaagttattcaagtcaataatcaaaaattaaaacaaatggctcattattatagtcaattttccagtaagaaagtgcctactggagccttgttctcaattagtagtggatctgccactgtaactggctactactctggtaaagtcatgtttcaaggcaaaactgctagtgctgaggctgctaagtggcaatcaaattcaattcacagtcttgacacgcctaaaaaaatgggcacaactcttccagctgatttcgctaactggtcggttctaggttctgatgaggtaggtgctggtgcctattttggtccactaacaacagccgccgtttatgtatcccaagaaaacttagagtgggtgcgagcactaggtattgctgactccaaaaccttaacagatgatagaatgaaaaaaattgctcctcaaattattgctaagctacctcatcatgttgttaatttaatgcctgaaaaatataatcaactgcagccattgcataatgtgaaccagatgaaagcaatttctcataattttgccttaggtaaagtattggataaaattttcccaatcacaccccaagccattttaattgatcaatttgcacaacaaagcacatactttaattatctcaagaatgccaagcaacaacggataatccatgaaaatgtatacttcactactaaaggagagcaatatcatttgagtgtcgccgctgcttctatcttagctcgtgtagtagaattagacgccatgtctaaattaagtgtcgaagctggtatcaagctgcctattggtgcaggacgtgaagttgatactgttgctgcggaattattacgacgaggtattgatttgaaacactacgctaaactacattttgccaacactaaaaaagcagaacgcctattatagacattctgcttttttatttatgcttctggttttgctgttgtttctgaagtatcgtcatctttaatcgatgatgcttcagcatcttttacattttcatcgtcggccaaatcagccaaagcttcttccaaatcaacatcatcttgtgttaattcgatatcctcactggcgaatttatctcgtaaatcagtaagtgcatcttgtgttttttcaatataaggagtaacaaaatctttagctttatcaacatatggcgctgcttgatctgttaaatccttaattttttcagttgcagcgtcaatttggtcagcatatttttcttgactatccgtcttcaaggcagcggttttttctttggctttttctgtcacatcagccgctacatccgctgcattgtaagcagcatcataagccttatcacgtagcaatgcacccgtattatgtgctttggctgacaattcatcctgcttatctttgggcaatgctttataagcaacatacgccgccgtagttgctaaaacacctgcaataaatacttttgtctttgacataattagacctccgtcttctttttatttctaaacttacccatagccgcttttgttgcgtttttagtcatagcagccgccacaccagttgcaccggccttaacacctgaaaacttgtgagtcacattttgcgctgaattatttagttttgacacagttactgataaatcagccattgcctgtaccgttggatcaagggttttaactttgccattgatatcatttagcaatacattagcatttcccaaaatctcattacttgaacgtgcgatcgtatcgacatccattgttataacacccaatgaacgtgttaggcgtaacaagaatatgccaataaaaatcaccaaaagtagaaaggctacggcaaatataattaatgctaattgtcctggttccataaaatcctccgctaaatatcatagttatgattatactttgtttaactttttatgaaaaatttaaaacattctcacttgtattaattataacaaaaaaagacgttctacgaacgacttttttaatagtgtattatttatcatggtttaatgtgcatagtcaattgcacgtgtttctcgaataaccgtaactttaatatgtccgggatattccagtttttcttcgacatccgacttaatgtcgtgtgccaatactttagcttgcaagtctgtaacctttgtaggttcaacaatcacgcgtacttctcgacctgcttgaatagcatatgctgtgtgaacctcctgataattatttgcaatcgcttcaagatcctttaaacgttgcacataattttctagtgactcgctacgagcccccggacgagcagcgctaatagcatcagccgcagctactaactcagcaatcggcgagattgctgcaacatcaccatgatgagaagcaattgcattgattacaattggcttctcattaaacttctcagctaatctaacgcctaattccacatgggaaccttcgacctcagcatcaactgcttttccaatatcgtgtattaatccagcgcgtttcgcaagcgcgacatccattttaagctctgctgccatcattcccgcaagttttgcgacctcgattgaatgctggagcacattttgaccgtatgaagttcgatagttcatacgccctatcatcttaattaagtctgggtgcatgcctcgtaatcctagttcaaagacagcttgttcacccttttcacgaatcgtttcatccatttgacgtcgtgatttttcaaccatttcttcaatacgagacggattaattcgaccatccgcaactaaggcatctaatgccatttttgcgatttcacgtcgaacaggatcaaatccactcaaaacgactgattctggtgtatcatcaataattaaatcaatgccagttagggattctaaagtacgaatattacggccttcacgaccaataattcttcccttcatatcttcacttggcaaattgacaacagagacagtcacgtcagcaacagaatcagctgaggaacgttgaatagcttgcacaataatattacgagcacgcttctcagcttcgctagtcgcttcttcttccgcttctttaatcaaggctgctcgttgacgagtcaaacttgctttagtttcacttaaaatttgtttcttagcttcatcaggagacagttgagcaatttcttccaacttgtcttgttgtgtagtcaacaacttctgtgctaatacttcttttttatctgcgtcatcaaggcgtgtctgtacttgattttctttttgaatcaatgatgcatcacgttgattcaaggccgcatcttttttatcgaggttattgatgcgatcttctagcctttgttcttgttgctgcagatgcttttgacgatcattatacgaatcattaatttgatttcgataagtttgtgccaaatctttagcatcaacttctgctgcacgtttcaaacttttagcttcattatttgcttgttcaagaatgttagttgccatttgctcggcagaaataactttatgcgcgtcttgtgacttgcgcacatagtatccaataccaagaccaatcacaattgcgaaaaacactgaaatgattgtaactaccatgttagtatatcctttcagcttgtgaatattagatttcacatatattaagtatatatgttaattcatgacgggtcaatagagtattccagagaccgatgagttgttttacaaaaataaaaaagagcgttttagctcctaatttttaaatcgacggcttaattctcgctcttgatcacgttttttaatatcttctcgtttatcatattttttctttccacgacctataccgattaaaactttagcaaagccatgttttaaataaaccttcaaagggacaatggttacaccttgttcctgcgttgctttctcaagaactcgaatttctcgtttgtgcaacaataattgtctagtccgtaatggatcaacattaaattgattcccttgcacataagaggaaatatgcacattggttagtaaagcattaccattgtgtaccgttacaaatccatcccctatggtaatttgacccgcccgaactgacttaatttccgttcccgttaatgagataccggcttcaaaagtttccgcaatggcatagttaaatcgcgctttacgattttgagcaagataattttcagtattttgtttcttttttgccatgacaaaccaccttaaaagttacgtttgctatcccgtttatgcccctgtttactatctaagggtgctctctttggacgtggtccttctgatttaccacggcgctcgtttttacgcctctcatcacgattgcgacctttaccgaacttaccatgtgcctttgaagctacacgaatatctgtcgttggcgcatcttctggattaaccaatacaaaatcaactacgcgctcatctttattaacacgcaaaaccttgactcgtactttttgcccaatttggaaaatacgatgcttcgaacggccaattaatgcagcatgagactcatcatactcataatgatcatcagttaagttcgaaatatgaaccagtccttcaactgtattctcaagactaatgaacaagccaaacttcaacgctgaattgactactccatcaaactcaaggttaactttatccatcatgtattcagccttcttcaaagcatcaacgtcacgttcagtatcaatggctcgacgctcacgtgagcttgtatcttcaccaattttaccaagatgactagcatacttttcttgtgcttgaacactatgaccatgtctctcataccatttaatcaaccgatgaactgtcaaatcggggtaacgtcgaattggtgaagtaaagtgagtataatactccgcacccaaaccaaagtgtccaactggatccggtgaatatttcgcttgcttcatcgcgcgcaacatcatcgtagaaatcatttgttcagcaggatcaccagcaacatcttccattaacttttgtaacatgatcggtgttactttacttggatcaccaacaactgggtgccctaaagcctttgaaaattcaaaaaacgacttagcacgatcagcatcaggcgtctcgtgaatacggtacaagaatggtactttaagtttatcaaaatgctcggcaacggtttcattggccgctagcatgaaggattcaatcattcgttcagcggtaccgcgttctcgcaacttaatatcagtggctttaccatcttcatcaacaataatttgtgcctcaggtgcatcaaattctattgcgccacgctttttacgcatattatacagaatttcatgtagctcacccatcactttaaacatgggtactaattttgcgtactcatcttggacgaaaacatcaccctctaaaattttattgactgcatcgtaagtcatacgagcatgagatttcataactgaggtatgaagtctatgattcactacatttccttgtggatcaatttccatctctgcagacattgccaaacgcacaacgtttggatttaatgaagcaataccgttagatatatttctaggcagcattggaataacacgatcagtcagatagacagatgtaccgcgattataagcctcagcatcaatactagaaccttccgtcacatagtgtgaaacatctgcaatgtgcacacccagatggtagttgccattgtctaacttccaagcaactacagcatcgtcaatatctttcgtgtcagcaccatcaattgtaactaatgtttgctctgtgatgtcctctcggccagcccattcagattcggaaacttcacttggaatttcgagtgcatcatctaacacctcttgcgggaattcatttggaactttcttactgtagacgatttgtaagatgtccattcctggttcatctttatatccaagtgtttcggttaccgtagcaattatttctcgtggatggattttatcaggaaaacgagtaacttccgctacgactacctgaccatcattaggtgttaatccatcaccgctaactaacactttaaaattcattgttttcttgtcgctgaggtgtaattcaccaatcatgttgcgagcttctgaacctaatgaaaaagtacctactatacgctcgtaagcatgttcaataatctcttctactttaccttctggtccacgatctggtgttggtgatggttttaatgttgaaacacgtaccgtatcgccctgcattgcttgtagtgtattttctgggttaataaaaaagtcaggtaattcgtcatcgtatttaacaaacccaaagcccttatcattagcacgatactcgccaattgtatagccagcatttttgttatattgataaccatttttgatgtcgataacatccccgtcacgtacactagcgtttaaagcattgacaacctgcttgtatccttggctatccgtcattcttaagccgtcagctaagttttgtgcggtaaatatttgctcacggttagctttcaagaagccagtaagctgtgattttaattgttctagttccatatgttttccttgttagtttaatttactaccatgtagtatgtatgttatttactataaattgagataaaaaaaatcagtttacgaaaaaagcgtaaactgatttttttaatgtgctgaaatgtacattaaggcaaatccaatgacaaaccataatgccccaagcactgctgttgtacgacgcataacagcttcaaatccacgcgacttacgttctgcgaacaaatctcctgcgccacctgataatgctgataatgcatcttgttgtttacttggttgcatcataactgtcataataagcaaaaagcctacaacaattagagcaatagtaagtagtttttccacagttatatcctctattaaatcgttaacatttattatagcaaattttacgctaaatcgccaattttggcaaaatgttattagtttcccaatgccaaactaaacattagaataccaccagcaatagctacattcaaactttcagcctgtccttgaataggaatgtataagttggctgttgttttttctgccaattcagctgacatgccttgtccctcattaccaacaattaaaccaaattgtgtgcttggttcaacatcgcgatatgattttgctttttcatttaattgtgaaccataaactggaagattattagctgccaaggcagcaacccactcgcttaagtctccattcaagacttctaaatggaattgagatccttgcatagcacgtacaactttgggagcaaatgcatcagctgtgccagcacctaaaacaacacctttaaaacctgctgcgtctgctgttcgcactaatgtgccaacatttccagggtcttgaatcttatctaacaacaaccatgcaccatcgtgaacatagctgggatcaaatgtcttttcaggtaaactaatctctgcaaaaataccttgtggagtattcgtaccagcaatatgtttggcaacttcttcactgatttcaaaagccggaacaccatgaggcacatttgggagatagtcagccatttgtttttctgtagccattattgcatggaattttgcaccagccttaaccgcctcttcaactaaatgcaagccatcgagcaaataagtatgattctcttgacgacctttctttgttgcaagttttgcccatgctttcacacgtgcattttgatttgaaataattctttccatgtgtatttctttctgttctttctaagaactgacaaaagtacgtcaaaaaattgacgtacttacttcgaccgctgttgcttcccagcattgcgattctttttgttttgattttttacaacgtttggcgcatcagtaacttttgtgtttcctgcattggcatttggtactttaatatcctctgccattaaatcatcagcagtcttttgaattttaaattcagctgtaacgcgtttttctaaaccaggacgttgatagtgttgaattaatgtctggattaaagcaaatataccgccgataacgaagtataggccaatagcaccacttgcaatcatagcaaaaacaaaaatcattacaggactaacaaacatcattgcagctgatgtcttacgttgttcctcaggcatatgttgcatcattaaccaagcctgaattagataaataataccggcaacgatggcaaaaactaattgtggtttccccaggtcaaatcctaagaaggatgcaccctgcaaagctggtgcatgcaaaatagcagaatataatcctgagaaaataggcaattgcattgccattgtcaaaaatgaaatgccaccaataacactgacatcattttctcgatataatgacatcatcgccatactagctttttgttgttcttctgtcgtagctgccttacgagataaagtttgtaatttatcaatttccggcttcaacttctgcattttaatttgattgacagttgtattaacttgttgattcaagaaaaatggtaataaaatcaagcggaaaattgcagttataacgataattgcccacccaataccgtttacaccaccgataaaatgagcgatattagtcattaattcagccaatggctgaccaatccaacgatacattctactgtgttgattataaccaccagtaagcaaaataatatcaaaaataacaaacgcaaacgtcagaacgcgttttaattgtttcataatcagggtttctccttgaaaatcatgttaaaaaagttgcgcacaattacaagatactattatagcaagaattacccacgaatagcaaagtcatttgtttcaaacaatggaatatttgttgtgataactttgtcaacgcgactataaaagcctggccccttctcgagcactgacaaaaaatctattaaatcactttgtgaaccctgagcttgtattttaacagaaccgtctgtttggttacttacccaaccaacaatattgtgttgctgtgcagttcgttgtgcaaaccaccgaaaaccaacaccttgtactaaaccaaaaacatcaacttcaattgctttcatttttttcctcaacgtacaaaggtaaatatactgtgaaaattgaccctgagccttctgcactttctaatgcaattgtaccaccataagcctctaccaaacgttgagcaatacttagtcccagcccagttccccctttggctcgtgatctcgccttatcaacgcgataaaagcgatcaaagacacgttttgcatcttccggtttcaacccttcaccgaagtcttgtacgccaatttcaacacgatttgctgtctgtgacaaggcaaaatgaatttcatgacgatctagagaatactttacagcattgtcagctagaataattagaatttgttccatatgatcttgacgaatcttaacccttgccttcgttgataaatcatcatctagggtaaaagaaaagtcaggatgtatcattttaaagttgtcataaacacgatgcattgtaccgccaacatcagtaatttctttcacgttgtcaactggaatttgctcagcacgtgttaaattgagcatttcgttaatcagtgtctccattcgttgtacttctgccagagaggatttgattgaatcttccaagacctctggatcatctttaccccagcgattcagaagttccatgtggcctttcacgattgttaccggcgtacggagttcatgggaaacatctgaaacaaattgctgttgcgcactgattaatgcttgtagacggtcaattgtgcgatttaaaatacgtgttaaatcagaaaactcatcatttgcaccaacttcactggcacgtacttctgtcatcggatcatcttcaaaagcttcaatggtggtttcaattaatcggactggtcgtaaaattactttagttaagataagtgcaaatatgaatattgccaaaccaccgaaagcaataataacccacaaccaaaaaataacttcattcggcagtgcaccatagtgatgctttatcaacccagaaagcaataaagcaaatactataaatataacaaaaaagccggacgccattccaagtgctaactgccagcgcagtgagaatcggcgtacagcttttttagttgtttctttttcattattgtccataattaattagaattagctgcgcatcacgtagccagtaccacgtactgtttggatatatgatgccttactttcaggatcatcaatcttattacgcaagtaacgaatatacacatcaacaacattcgtttctacttcagaatcaaaaccccaaacttctttcaataattgctcacgagattgaaccacattaatattttctactaatgttaatagcaagtcgtattcacgctttgtcaaattaataatttgatcatcgcgacgtgcaatacgattttccttttcaatacggaggtctttgaagttaataattgaacgatgcttatcgtttgtttcagtctcaattgcaatacggcgcaaaagcgaacgaatacgagccaataattcttcaattgcaaatggctttaccaaataatcatcagcaccataatccaatccagaaacacgatcaatcactgaatcacgagcagtcatcataatgattggtgtttttttaacttcacgcaatcgacgtgcaacttctaaaccgtttagttcaggcaacatcaaatcgagcaaaataacatcgtaatcattttctaatgctaaatctagcccagaacgaccatcattcaccgtttcagcttcatatccttcatgtttaagctcaagaccaacaaactttgccaagttttcttcatcttcaacaatcaatactttactcattttttgtcctcaatgttttaaatcggcagaagccgagtctatttgtattacttccctttattttagagcatttgtttaactcttgcaagtgttttctcattctttgaaaaaatcgtctaattttgacaaccgagggtcaattttgggttcttcctctatcattttctcattttcataagcttcttgactgataacatgccaatcttttccggagggcaaattatcgccggtctcttcctcaggcgttaaaatctgtaaaggcaaagttgctataatattatccaaaatagcatcgtccacatttaaggaatcattctcaagtacaaaaacagcctcggtttcttcaaaatccttgagacgactctcattttcaatgtataattcagaaaatgctaaattaattggcacaaccacggggtctaatgaccgtgaagatggcactgtgatattccctagaacattcacgtctaaagtgatatcatcattatctaaatagttaatgctccccgtaacttcaaggggtgataacgctaagacagtttctgaaaaacgacttttagcttgttcctccaaattcaaagtttcttcgataattaacggactttgacggtattttaataattgattttttgcatatttcatactatttctcccaatataatggcattcgtgtcacatcttgtgtcggcgcaccttcatttgccagtaattgccacactttaccagctttataatctaagcgcagattacttttagccaaacttgaatcaactttactgataaggggcaatgttacttgttttttaatttcatttaagtattgctgccccgttgaagtaaatcctagaatacgcaaatatgggtcctgcatagctgcttgcatctggtctaccttaatattaagcaaagtatataataatgtacgctgtattcgagtaaacgtataacgtttagatttggtcgatttaataaagctttgatagctttgtggaccagaatcatttagagctgttttagcaaaacgatgctccaacccctcagccatttgataaatttgacctagttgaccaactgtatctgttgttaaccggtacttcagcattgaccagaaattactttcgaaatcaatagtattggcagcggtagccaatgctactttggtcgcttcaggcaccacatttttgattttttcagtttttcccttgtgtaaagctaaacgaatagatgacgctgaggcaatcgattgttcgtctgtaaagttggcatcatgataatttgcttcagcgcgttgaataggtataatgccaatgttagcctgttggtttagaatagcactagcataaccaagcgctagaatatcattaggctcttccagtttaaagctagtttcagcctctaattgtttagcatacgcactagcaaaggtttgcgtatgattcttaaattcttgtccttctgcaatagttggtgcttgtttagctatggatagaaaatcaacctctggatgctcactgccaaatacaatattatcgacaccaagagcggataataattgaatcgctccatcagcaaaaatatgacttggttgcactgcaaaaaaagtgggtaactcaatgactaaatccacaccattttccaaagccatttgtgttctttgccatttgtcaaataaggctggttcaccacgttgcacaaagttaccagacataacggccaccactacatccgcaccagttaatttcttggcctgttgaatatgataaatatgcccattatgaaatggattatattccgttattattccgactgcttgcattatttcaccgccctaaaaaaccaacgttctgtgttttcatcaatattattttgtccaaagttcgcaaaaacttcaatattatgaaaaccagcacttcttaaggtttcttgatatgtctttaaatcataggtttgctcatgatgaatttcgcgcataatcttaaaagcgtcaattgcctcatcatacacaaaaaactttaagtcatggtcaacactattctcttgctcaccaggataactagtccacataaaaatgttttcatcgtcgtcatcattattgtagtaataattatcgtacagcacgttaacctggtaaggtgttatcacatcaaataaaaattgtccgccaaccgctaaatggtcatacacttgttgaatagctaatttaaaatcagataaatttggtaaataatttaaagcatctgcaaaactaacaatgatagggtattcctttttccaatcagaaaagtcacgcatgtcagcttgcaacaaagataagtcaacgtttgcatcattagcatgcttttgtgccaatgacagcatttcaggtgacaagtctagcacatcaacagtgtagccaagctgtgctaataaaactgctaatcgtccagcacccccacctaaatccataatagatgtagctttactattttttgtcacgaaatcaacccactcttgatataattctgaatcaaacagttggtcatatttttccgcaaatgtagagtaattgttatttatttcattattcataattttaattttaacatggtgtcggtctgaacggttatattattgttcttacaaactaaaaaatcgagacattggcctcgattttgcttaattttctgttaatagattatcaagattaacatagggggcatcattccacaaacgttctaggttgtaaaaatcgcgaccttctgtcgagaatatgtggacgataacatcccctaagtccataagaacccattcccctgcttggaatccttccataaagcgaaccgatccgcccgcttcttgtattttatctttaacttccgtagcaatagcttgcacctgtcgtgtagacgcagcgtctgcaatgacgaagtaatctgccattaagctcactttgcgcatatcaagtgcaacaatattatttgctttcttattatcaactgcctccacggcagtatttaaagtatcttgtacatttaatgctgttgttgtcatattttatttttctttcttaacccaataattatacgtttcaagtgatttaggataaattggtgtttctttgtgaatcaaacgtgctaaggtatgaacgatttgatatttaatgccttgcgctaaactttggtcagtaatcgtacgggcttcctctacccctttgaaatcacgacctaattctaaataatctgccataaatataacttgtgacaacttattcatactagcgcccgcacctgttgtgtgctgacggacagcagttaatatatcttcatcaacaattcctagctcgttacggatcatttccgccccaacaataccatgccagacataatttccccagttaatcaaatctggatccatatgctgggtttcaataacctttaaaaaatcattatctgatcgctctttggcataatcatggactaaagcagcaacttctgccttgtcaacatcaacatcattggccttggccaatttcactgcatagtctcgtacacgcaaaacatgctggtaacgataatcagataatttttcggaaatttttgcttctaaatcagtaatcgtaccattaaaatacttagtcatataagcctctatacaaatcgtactctcgaataaatagcgcttcacgttctggcaccaaataattaatactctgattcatacgaattcgtgtccgtacttctgaagcgctgacgctaatatttggaacatcaaaccatagcacgggataatcggacgttgtctcttgtccagaatggacacctgcagcaaacgtaacaatttgacttaactcatcaatatgatcccaagtgggtaactttctaactgtatttgcacccatgataaaataatattcattttctggatgcgtatccacaagttctttcattgattggtaagtatgagattcaccgccattacggatttccaataattcaagttcaaaaaaaggattatccaaaattgccatgtgaaccaattgcattcgataagacggttcaattgcgctagcatgagtagcatcaaccggctgtgcattaggcatccaataaactttttcgagtccaagctgtttcccaacacattctgctaaaaccaactgcccaacgtgcggtggattaaaggtaccaccaaaaattccaatacgatgtttggcctcacttggttctagttctaattgatgttttagtgcagttgttgatgttccaatcatagccatctcctcagatttttgctagatctaatgaaatcttcttatatttgtcttcttttgctggtaaatacaaaacaaccgtacgaccaattgtctgtgcaaccgtaatatctgaatgtgcttcaataaaatcagcaacttcttttgctgtttcgtcagcactttgctgcaaactaattttgactagctctcttttagccagtgccagaacaatttcatcaacccaattctgagtcaatccattctttccaactgaaaaaattggcgataacgtgtttgcttgtgaacgtaaataacgtttttgttttcctgttaattgcattaaatcattgcctttcgaatgaggacgctgacgccctttggtgcccaaccagctacttttataccagccggtacgctaatccaacctaaacctgaaaagacaatgtcactgtcttcagtaatgctgaattcgtgtttgattagattttgtagctgacttggtgctggtactagcagcccacctgcatgctgttcataaaaatcatccgcaccgataagcttcgtacggtgcaaattcaagttattttcaaaataagccgttatggcactacgcgcaccactgataaaatcaaaacgtgccaggccgccaataaaaattgtttgttctggatttaattgatacgtccgtggcttaatttcattttttggtagtgcaaactttaagtccttatcggttagcacatgagccatctgatcgcgcttaataattcctggtgtgtcaattagttgctgaccatcttccaatggaatttcaatgcgatcaagtgtggtccctggaaatctcgatgtagtaatcaaattttgaatgcctgtgcgagacttgataatttgattgattaatgttgatttaccaacgttggtaaccccaacgacgaagacatcacgtccgtcacggaaattatcgatggtatccaataagtcgtctaaatttttgggacgggttgcagacgtcaagaagacgtcgacgggttgaataccttgtgccttcaattcagtgcgcagccaatttttcaaacgattcttatttaatagcttaggtaataaatcaaccttgttagctactactaaaattggattatcttttccaacaaagcgaggtaatccagaaattgcagaaccagttacatcaaacacatcaataacataaacaatcaatgccttggtatctgaaatttgatgaagcaagttggcaaaatcatcatcagtaagttctactggctgaatttcgttatagtgacgtaaacgaaaacaacgttgacaaaataattcttcactgctaatggattttttgagggcgctcattggcaagtaacctattttgtctttatcttcgacttgcatcaaagcgccacagccaatgcagcgcaatccttcatttaattgttcttgaacatattcatcagtaatttcagttgtcacgtaacgttttctcccattttaagtgtggatgtgcttgaaacacaatttttttgacatatttctcaatccgacgatttaaccatgtttgccacatgtctgactcaattaagcgttgtacaagtacactacgtacgccagcactatgcgctgcccagacatcagtcaacagttggtctcccaccataatgacttcttgtcgctttaaatggtgcgtgcgcaatacatgcaagatacctcgcggcaatggttttaacgaccatgaaacaaatttgacatcaagtggtttaactgctttttcgacgcgtttcgtagtattattagaaaccacaattaattcaataccaccatcccgtaaatcttgtaaccactgctttaattcaggtgttccatctgggttgttccacgctaacaatgtattatctaaatccgcgagtacagttttaataccacgcgctttcaaatcttcaacagttaaatcgtaaattcgttcaaccatatatgttggtgtaaagtgttctaagcgcattatgtcccatcgtccgtttattttattcttttcccattataacaaaaaaacacgtatgtcgtgttacgtgtttgactaataccaattattaacttgccaatgagcaatagcattagcaacagttccatagcgagcagagatatacttctgcattgcttctaactggactgcataattaccatgataatcttttcccggaacatattgcgcgtagtaattttcagacagctgaccaataccatagtatgcaccgttttgagcattgacgtttccgccactttcatgttggattaaccattgtatgtctgatgatgcaaccggtgtttctgttatggttgtattctgtgttgactgattactttctgcaacgacctgtgttggttgcgtctcattcactgtagcagctgtttttgacacttcggcagtcgttgttgcagaagatacactggttacttgcgctatatctgcagctttttcttgtgcttcacttggttttaaattcgctttaacttcatttttctcactagaagttactacttttttaggtattgcttcaactttagtaagcttaacatccgtaaatgatgaaatggcagaactaactgctttgacattcacggtttgattcatactggcggcttcagcaggctggttttctgtttcaagttgcgttcccaaaacaactaaagataaaccagttaatagggcacttattattattattctcttcatcatgtaatccattgtgccgccaaaatattacgtaaatattacaaatggtgataaaaacgtggtctaaaaatacttaatatacaaaactttgataagcgtttaactaaatgtgtaatatttagtaatgtggtaaccaattagttaccacaatcagtgcaatcattattaaatacattgaccaaccccatacaatgtgacccaaaaattcagagaaatgttctgaaaacggttgttttaaagcggatggaatggttttcgtagctggtaaaataataatatggaaaatgatccaaatcacaataccatacacgctaccttgtccaaacgtaacaatagggaaatattgatcaagcaaaactaacaatacaccgaaggcaatcgaaaaagaaaagtgcatgattagcgctacatagtgcactttttgatcagtagcataataaaaataggcgtgcgtccattttcgtggtatacccatttgttgcagcaaccgctgtggcggattagtttcatcacgttcttgtgttcttggtggtaaaatcgcttcccagccgattttaaccattccagaaataacccctgcaatcgttccaattacaacgacagccaacaaaaatttcaacataaatttctcccttaccaactaaaatatttcactttttatactacacgttatttttatattacaaaagagcaacactcataagaaggtcgctcttttgttcaaactattaagcattaaccactgtgaaacgctttttttccgaacttggtttaataatttctgacacaattgctttggccatcgtaccactatttgtaacggattcgttatcttcaccaaaaagcagatagtctgttcctaacttatatggggttgcttcgcctgcttggaaagtaataccaggtgatacaccagtccaattgacattatcaatatttcgtaaaaagtctagttcctttttctgattatctggtattgatacccaagaagcagcatctggcaatttttttaaatcctctaatagtaaatggttgtcttccccagtcatcaagctgcctgcacctaaaataaagattaaccgtggaacagttgtttctcggaacagtccaataagataggctgctaaatcaatatgtcgatatgccagcgcaggagctgtagcaaatgcattaataattacatcaaactgcaacaattcttctttagtcaatgcaaacgcatctttttccaagacttttgcgtcctgaccaagtgttttatgcgctttgacagtagatcttacaatcgcggtaacatcaaatccctgatcgaaagcttcttgatatactgcagagccagccatacctgttgcgccaataacaccaattttaattgccatgtttgccttctttcttaatactaattacttaaagatcttaaagcgtgcatcatccgtcatgtattctttagtacctgctggtgcttcaattgatccaaatggcatctgaccacgtaagttccatgattcaggtatatcaaatgctgtatgtacgtcgtcatctatcaaaggattatagtgttgcaggctggcaccaatgtcatttgctgccaaggcttgccaaacattaatctgggccataccatttgcttgatcagcccaaattggaaagttttccgcatataaagaaagctgttcttgatattgctgaacaatatcatcatccgtgaagaacaggattgttccaacgcccgccttgaaactatcaactttttgacgagttgctttgtaactttcttcatcaggaacttctgactttaatctttcggcaactatttcccataatttatcagatgattcaccaaataaaatcgcagctctgaccgtttggttgttaaaagagcttggtgattctttaattgctgactgaattaattgggcaatgtcctcattgttatcagctacattcttgcctaatgcataaatcgatcgccttttcttaattgtttcaatataatcttgattaaccatgtgtgacacctctttcattttgtagtatacttttaattatagactgtaacaatacttgttacaggtaaatcatactacggataatgaaaatttgtcaagaaaaaagtatcgaaatgatactagaaagtgaacataaccatgaaatactctactaagttaagtgatgctatacatattctaacttatatcgtcattaatcaaggcactgacctgtcaagcacacaaattgctaagagtgtcaactctaaccccgtggttattcgacggattatgtcacagctcaaaaatgatggttgtttattatctagtaatggacgtgcagatccaaaattagctcgtccagccgacacaattagtttattagatatttatcgcgctgtggaggaagacacctcatttctcaaaattgacaccaaaacaaatcaaaattgtaatgttggtagtcacattcagacaactttggataaatactataatcaagtacaagaagctgccgaaaaagaaatgaataaaattaaattagccgatatcatcaaggaaattcaaatagacaattaaatcaaaaagccaaaggtcaaaaggacctttggcttttcactatatatacagaaaacttatgctgacacagcatttccattattatcaaattggtaaaccttaccctgagcacttattaaagcactatcttttgtttgtacaccagtgacttcatcaaaatgttgtaagctgtcgtcaactgctttaaaacctttgataagttgataattagcatctgttaaataccaattaccttgatactcgaaataatcattttttacagcgacaccttgtgttgcattgaaataataactcaagttagtatctggatccacaatgatagcatctttcacttgctcaccgttttgatcgaagtatcttagtacaccatcttgcaatacaaaccctgttttcgcacgaccactatcatctaacaacatatatttaccatctgctaattgataatactgatttgtgatcaaatttcctgtgttatcaaacgcataggtaataccattaatcttctgaacaccagttactaggcgaccatcagtggcactcgtatagaaagtatcaccgtctgcattaatgaattcacctttactttgatgaccatcattatagaaatattgttttttaccattaattgtttggaaaccagtgacagcatggccattaccatcaaaatagaaccattgattcttactgttttgcacataacgtaggatagctaagttaccactacctggttcaaagtaatacttataaccatcagtgccaatcacaaacttatccttaacctgcacaccattttgatcaaaatactgttgatgtccatcaatcgttgcaagccctgatttaagcattacaccagcatcatcaaagtaatacgcatttccattttgatcagttatatattggtcaaaaacttgatgacctttcttatcgaaataaacaattgtaccatcttcgttttgtaagaagctcttgaccagttcgataccattaggtaagaagaagtaagtatggttattaatcttttgcaaacctgttactaaatgacctgttttatcaaaataataatagttattatcatcatcttgaataaatgcattttgggcacgataaccacttaatgtataatagatgattcctttatcatcgtgtgtaaagccagtttctgacagatcattagttaactgttttggtaagtagtcaccatcctcagtgttcgaaacgaccttaaagtacttattagaacccatatctttcaatacgtatccagcacctttaccttggatgttagagccattgaagtacttagccgcccactcagtaatctttacactgccatcaattggaacgccagttgagatttgattcactttaaatagggatggatagagtgcctgtaactcttctaagaaggcaccaccatacatctcttgatattgaccacccccacgactttgtacaacatataaggcattgtcaatatcagaatctgtatcgtcatctccaaatgaatttgttcttgtgacagtagctaattcttgctctggcaaattataaatttggtccggcacccaatcggcaatggcttgaataccgctagcatgtaaggctttaatagcatcgcgcaactgatcagcagttccatattttgtcggtgtgccataacctaagtcataacgatccgtgaatgcatacccgttttgaataattgaatccaagaaacttgtatctgtacttgaacgatattgtggtgccaattggaagcttgtcacaccccattgcttaaattggtccgcattctgagcgatgactacgtttgtatattcactgctgtctgtagcaaatgcttggaagtttgagaaaccttcgtagatgacttgagaatcaagagcagcgtttgaatggaacactttatcactcgtgtttgttgttgtatcagaggccgttcgtgcatcttgatcttgttgcgcacctaccggaacccaaactgccaagtaaccagaaacttgtggattttgtacaccataaattgattcattcgtaaaaatcaaatcgccgttagcatctgtgtacgccacaggtgcattttcatcagtatcataataagctaatccatctgcagttgttgataacaaagcacgataagcttggttcttatgagctgcccccatgtgcaatgtgactgtatgcccatcctctaattgtagctccgcgttgttgctgacgatgaccccaacaccttcagtacgcgtctcagatgttccagtgtcagaagccgtcatggcatttttaccatagcgaacactggttaacacgtcattactatcaacggacatcgattggccaccagcaacatattgaactctagcctttagcaaagtgttaatcgcatcatagtatggtgactttgttgccatatattgaccatcatctgtatataaatcgccataatagacacgaggaacagtatccttattggttagcaacatcgcataagcactagccatattatattgtgtgtactttttgtctgctaatttttcatcttcattgtatactttgaaagcagctgccaattgttctgttgttggtgctaaactattttcaacatcaggatacaaatcggaaacaatttgggcaataaccgtttgcacttcgctgtcgtgtgcacgtacaaagctgtaattaggaatggcttcgttttctgtactatcattagatcgatcaaccatataataatccacgaagcgctgcattgtacctcgtatgtcagatgattttgttagagaccagattaattgtgtgtgcacataatcatccatggttaattgattgcttccttgatctgttacatacaaaggatcattgtgactccaatcttccaaaattgaaagatgctgattagcagtagcatcattttgatcaacaccgtaagctagtttgaaataatcggcagcaatttgtaacaaatcagcatccacattgtcgactgcatctacacgaataccatcaaaattagcatccgcgtcgttggccgtaatcgtaccaaaattcattaaataatataaccaattcaattgttctgcttgtactacagggtttgaattatcaacgtcattggctaacaacaattcaaaaccaccttttgaattatctaaattatacgcttgttcaccagtctggtttgttggtgtccgattaagtagtctaaagtttgaattagcatcaggtgtcagtggactgttgacataagttaatgcgccattttgtaaatggtcattgctcatatcttcactagtttcattccactgtggttgcgtgacaatgaaggccgccattgcatcctttaaccactctgtactttgttgcgcactaattttcatttcaattgatttttgaacatagttacttgcttcatttaataagctttggctatccccagtttcaaaactgtccgcattactgataaaccctaaatcagccatgtaatttaaataattgacctgggtgttcttatctggccaccacactgacaatattggtctgaaatctgtatctgtagaaggttcccagtctgttccgttacgtaaaatatctgttggacgataccatgaactagctgttaaatagccgtcaatattttcaaagtcctcagcatccgttccgtgggctgcattatgttcgctataatccgtgttttgtgtcgtcaaaccttcttttatttcagaagttgtgttagaaacttcttgccctgtttcctgatcaaatgtcattatttgaccatcaatcacaccagagaagcctttttttagttgcccaagattatcaaaataataatttttgccctcgatgttcttaataccggtagcagcgtgtcctttatcatcaaagtagtatgttgtaccattttcagattggtaatattgattaaaaatttgttgcccttcatcgttaaaagcaactatgttcccatcaatgctttgcagaccagttaactcatcacctgagtccttatcaaaataatatgtttgattatcaattgtgacatactgtcctttgacttgtttaccactctcgtcaaaatattgaatattgttgtctatcgttgataaacctttagcatttttgccatcatcaaaataataataccaactaccgtctttttcaacgtacttgccgctaacttgttgtgtttcgtcagttgtcgtttcagcaggatcagtgtcagttgaagcaactgctgattcctcatctttgctagtaacattggtttgagcgacttcatcttgtttgttatcgactttttcattatcaagtgcatgatcatctgactgtttttctgtcacattattatcagcagattgcgttgtgtcgcttgcagctgttgttacattatcattagtagctgcagactgtactttatcattttcttcggtaaccgtagtgttctgctgcgtatccgttgtattatctgaaacagattgaacgttattcgcactcacatcaggtacactactgtctcccaaaacacttggtgttgctaaagcaaatgaggcggttaatgcaaaagcacaaaccccaccaactacccaacttttcccaactttataaagctttttccgcattactttttctgtaaatggcataaattttctccttataatattctcttctattacattgaaaaattataacttaatttatttgtaaaaacagtaaaaatttcaatacacaatcgacatatttttaaaaaacattgtaaaaacagtcaatcagagaattatattaatattataaacattaatttttttataaaaaaacattgttaacttatctagtgataagttaacaatgttaattattattaattagtcattaattttattgattataaaataataaaaaaataaaataaaatcacataatatataaaagaggtatttaacaagactagtatgtctcgtaataaatatacgaaataatgaaattagtatttttataaataaatcgtgttggtaataataaatataaagtaattaaaaataaatatcattgttatttattacatcatattctaatctttttgtatactttagaaattataagcaacatcgctagtataacggcttccaatgccgatgcaaaatatcggtgtccatttgttttagggagctgtaacccattatttttggattgatttattttctgtttttcaatatctttttgagaaactacatcattggcgttatcttttgattctaaattatccgtatgcaatgtctttccttcattctggttttgctcacttttgtggtaactacttgtctccccaatgatagcagctaaatcatttttctttaattgatcggctgaaaaagtgctttgatcagaattgtgatcggcttgataataactctctaactcttgattaggtacgttatctgcatcgttagctgaaacttgcttttcttgaacttgattgttgttttcagtaggtgagcactcttctttgactatcatttcctctatggcatcaccgcttgttttggatgtacttaaggtattacttttaaagttctccgtattgtctcgcccttttttagtatcaatgctgtctgcaacatctttgtcctcaatactatttgaggcctcttgattatttaaactgttcttgccatcgataccattttgaccatctttgccgtttacgccatctttgccgtcgacaccattttgaccatctttgccgtttacgccatctttgccgtcaacaccgttctgaccgtctataccgtttacgccatctttgccgtcgacaccattttgaccatctttgccgtttacgccatctttgccgtcaacaccgttctgaccgtctataccgtttacgccatctttaccatcgacaccattttgaccatcaataccgtttacgccatctttgccgtcgacaccattctgaccatctttgccgtttacgccatctttgccgtcgacaccattttgaccatctttgccgtttacgccatctttgccgtcgacaccgttctgaccatcaatgccgtttacaccatttttgccgtttacaccatttttgccatcgacaccattttgaccatctttgccgtttacgccatctttgccgtcgacaccgttctgaccatctttgccgtttacgccatttttgccatcgacaccgttctgaccatcaataccgtttacgccatttttgccatcgacaccattctgaccatcgatgccgtttacgccatttttaccatcgacaccattctgaccatcgatgccgtttacgccatttttaccatcgataccgttctgaccgtctataccgtttacgccgtctttgccatcaacaccgttctgaccgtctataccgtttacgccgttcttgccatcaacaccgttctgaccatctttgccgtttacgccatttttgccatcgataccattttgaccatcaataccgtttacgccgtcttttccatcaacaccgttctgaccgtctataccgtttacgccgttcttgccatcaacaccgttctgaccatcgatgccgtttacgccatctttgccatcgacaccattttgaccatctttgccgtttacgccatctttaccatcgacaccattttgaccatcaataccgtttacgccatcttttccgtcttggccgttcttgccatcaacagaataagtataaatcacccaaacattctgttttggattagaaatatttttttgctcagtaaatacaccgccattaccatctgctgtataagtataatgtagtaatccatcattagaattggtaatgcctgccacttcttgattaaatgtttctggaatctcatatgtggttacatcttcgtctgaattattgctaatgaaattacctacttcatcgtaataagattgaccactagttcctttaatagtttgcgtcgactgtaattctttgccatgtatcctcttaagaacatagtgaactgtgacttcagattgatttttcacgcttgattctgtcaaagctgggctagttgctgcaccataacccttctgattattttcaggtgttcttgtatcatttgatacttcattttcctgatgaacttcgggatctgaatcagtaatttctgctactaatggttgaatattattgtttttttcgtacgttatagtatttaaatgataagtaaccgtaactggatcaatcttttccggctttttcaaaaatgctagttcatcagaattcatattatgattttcatgccaccaacgcgcatttttattcatcggaactgcaccaatatacaatgttggtttatccgttgtaaaatctgtaaaagatacaccttcttcaatagcataatgttgtgggttggtatcctcatcccaatttggggattggaaatcagcacttgtgtttacataggcaagtccatcaggggcattgtctacaatgccatcagcgctgatataatctaagccaattgttgattgctcattaataatagctgttttggcgtcattcgtttgaacatactctttgcgattaccattccagttatcccactctggaccagcaaaatttgtcgaacttaaggacccagacaagaaatatactttaggttcctcatttgaaccaggaaccttagaaatcggtacaacttcatgactatcactataggtaaaccagaaagttgtttgccaatttagattcgttgcccatatgttatcaacggcattactactgatagctaaatgcggaatgccagactccttatagttgttagtgtcattccaattgccattttgtaattgaaaatcatggaaaatttcgtgaaaatcgacacttcgcttattaccatcagcatcctcgatacttcctgaacgtgaccacgttttttcgattgtagcattcaatacctgtggccctacatattcccatactttcgtactatcgctgagatttgaatgtgaaccaatacccgtgcagattttactgggttctatattcgacgttggactactctcatccgccggttttgaagtatcaaaatccaatgcttgtttagcagctgatgttgcaatctgtgttttgccatccttattttgctgtttccccttatgtaaagctgattcgtattcttcagtatgttgattaaatcgttgattattttgctgttgcgtcttttcggcattctgtagttcagaaatttgttgtgcatagtcacttgcaatatcgtttttaaccttagcaatatcctccgtatgctcagaatcactcactatattacttcgggtgggttcctgtttaacaacaacccccacactttcagccgattcaacagcactaacaatttccgtatcatctaccgccatagatgtctgatggtccgatggattctctgatacgagaacgacatctttatcattttgaactaaactgctttgctctgtagtctttccatcatcagcactgacaactgttacagatgcgttaaacaacaccacagcaaccgttgcagttatccataatttccctgacttatataatttatattgatcttttctattttccatatgctcccccgagtaattattgtaagtgttcattatatcattttgataaacgttaaacaataattgtataactttagcaaacatttaaatgaaaaaaatatccttgatttctttatcaagtcctttagcaatttttttagccgttggtggtgatggatgcttcttattatttaaatattctgtcatcaatgaataattgacccctattcttttggaaaaaatcgcaatactttccccacgtattgcgatttcctttctgactgaagtagcatctcgaaattgtagtgttagtgacatttatcttccccattctttatcatagtgtcattatataggcgttgtatcacattgtcaaacgttttatattctgttttgcaacttattgtgtttatgtttgtttttcatttgtatataataaaagtaaacaactaacaggagggtttgcatatatggtaacaaaagaacagttcggccaaaaaattaaacatattagagaaaaaaagcattatactgttcgtcaagctgccctacaaggtaatttttcatccgcctatttatctcagattgaaaatggcaataaaaatattcctaaagtcgaaacactttatcgcattgctaaaggactgagaatatcaaaagatgaaatattacatattgccggaattacttcccatacttcacctaaacaccccaatagtgtagatcttggcaaacaatttgccgatgatgatttgctcttgtcttttgaaggaaaacctttatccccagaatatcgcgaagcaattttgtccatactccgcaccttgccagatgtcgatgaaaaaacaaaagaggattaattttcagtgtacatagatgacagaatttcaaactatcttgaacaaatcgtgcaaaaaaatggtttgacattaatacatattgatggcacagaacttgacccagatctggccaatggtcgtaaaagagctatcatcatcaacaataattacaaaacaaatttcagtcgctattttcgaattgcgcatgaaatatctcatttaatttatacaagaagcaacgatacttacgcgttttctcctctttcaaaattatcagatgaaacggaggctaatttacatgctatccaaattttagtagatttttatttctcagaaatccccttaaaacaagaacgttgggaacggcggtttcactttattgaagcgtttggtcttggtcaaataacgcatcttgttgaaaaaatattagcataaaaaaagtgccaccaattaattgatgacacttttttgtgttattagctaaattcggttagcttttaatcagctctccagaatttgcgtcataatatttttggctaccgtcagcttgtgttactgcggctcccttaacttgatgaccattggcatcaaaatacagttgttgtccatttatattttgttccccagttacagcaacaccattagcaccaaaatatgcccatgatccgtctgatattcgttcaaagcggttcgtaatcatttcgccagaatccgcatcgtagtagcgcatcttaccatcagtagtcgtatattcacgacccttaacttggttaccattgctttcaaagaacaaatgttgaccattaatgacttgtgcgccggttactatgttaccttttttattaaagtacgcccatgatccatctgataacttttcaaaacgattagtgatcatttcaccagaattagcatcataataatgcactttgccctttttatcagtcgcttccttacctttaatctgttgtccgtcagcgtcaaagaacaatttttgcccactaattgtctgtgcaccagttacagcgataccgtcagcaccaaagtatgaccatgtaccatctgtgttttcaccaaagcggttcgtcaccatatcaccagaatcagtgtcaaagtagcgtagctttccgtctgcatctttcacggaagtccctttgacctgaataccattcttatcaaagtattggatatgctcctgcccatcaacagtcacggttgttaagccagcattagccataacaccatttttgtcaaagtaacgccaagttttattagccaacatgtagtatccatcaacagcttgtttgccatattgattgaaataataaacattgcctttactatcttctaagatagcatcttgtaattcaataccattaggcaagaagtaataattattatcattgactgtctggaaaccatatgtcatataaccattcttgtcaaagtaataccaattagatttatcatcttggatgaatgtatcttttgcctggtatccacttgtagaataatatgtcatcccaccatcagttgaaataaatccagtgtttgattcttcattcgtcaactgctttggcaaaaatacactgttgttgcttgaagtgcttaccttgaagtactcatttgtagcccagtccttaaggacatagtaagcaccacgaccttgaatgttagtaccgttaaagtacttagcggaccattcttttatcttttcactagcatccattggtacgccggttgaaatttgatttttttcgaatagagcagggtacaatttcttgatttcatcaaggaactctccaccatatagtgcctgatattctccgccaccaatggtttgtgaagcatacaatgttttattaattacagaatcttgattatagattcctgagttgttgacacgctgtaccgcaaccacttctttacctgtcaaattataaatctggtctggtacccaatctgccattgccttgatacctgtctcatgcaaagctttaatagctgtacggagttgatctacagtaccatacttcgttggtgtattgaatccaagatcataacgatcagtaaatgcataaccattttgaataattgaatctaagaaactattatctgtacttgagcgatattgtggtgggaactcgaagttcgtaattccccaactcttgtataaatcagtattgtttgcaatttgtacattagcatattcagcttctgtggttggtgtagattggaagttagagaaactttcataaataacttgagaatcaagtgcggcatttgaatgcaatgtttgtccatcagtagttgttgctgtactactttcagttcgcgcatcttgagtatctgaagcaccaacgggtacccagaccgccaagtatccagaaacttgtggatttgctgtgccaacaatatctgaactattgaaaataagttgcccattactatttgtatatcttattaagctttgtgagacatcactatcagatacataagtatctatgccatctttagttgttaacaaagcaggacgataagcctggtttttgtgcgctatgcccatatctacaactacttgatctgtactgctcaacttcaaatctgggttattactttcaattaccgcaataccttgcgtacgcgtttcatttgtccctgcatcggtagcagtcatggcaccattaccataacgaactgatgtcaaaatgcctctataactgtcagcagccatactactatcaccttgcatatatttcatagacattgtttgcccgccagaaacatacttgatacgagacttcagcaaagtatcaattgcatcgtaataaagtgactttgttgccatgtattgaccatcatctgtatacatatcaccatagtacacacgtggcactgtatctttgttcgttagtattgtggcgtaagtacttggaatgttatattgtgtgaattctttatctgttttcaattgatcagcattataaattttaaatgcttctgttaattggtccatcgttggtgataagccatcagaatccggatcaattctttgtttaataatttcagcaataactgtttgtacttcactatcatgtgcacgaacaaaagaataatttggttgtgcggtattatctgtcgaatcatttgtacgatcaactaaactatttgtcaaaaatggttctaatccacttcttttattaccatattgatcgactgctggcatagtgagtgagtattttaatgacaaacgcaatttattatccattgacaattgattgtcgccattgtctttcacatattaagcatcattgtcactccagtcttcaagaatggaaacatgttgattcgaaattgcatcactcttatcgacgccatatgctgccttgaaataatcagctgcaatttgcaataagtcggcatcaacattatcaacagcatctactcgaatactatcaaagttagcatctgcatcgttattagtaattgatccaaagtttaacaagtaatacatccaatttagttgttctgcttgaacaactgggtttgaattatccacatcattggccaagaggaagtcataaccaccttgagttggatctgtcgtatacaaaggcgtgcctgtttgatttgttggtgtgcgattaagtaatcgataatcagaattggcatctggtgttttatcactattgacatacaacaatgcaccaccttgcaaatgatcagttccttttgattcactagcaatattccaatttgattggctatcaacaaattttgaaatgtcatcctttagccattgtgtttggccttcttgactaattttttcttcaattttcacttgaatgttctgtgctgctttgttcaaagcatcttgactgtcatctgaagtataaacagtttccgtttcagtggcatctaaatacttcatcgcattcaaatagtttacttgtgttgccttatctggccaccaagtcattaacaatggtcgtaaatcgtcatcctttgatgattcccagttttgaccgttgactaatatgtccttaggcctgtaccaactgtcggctgttaggtacccgtcaacgtttgtataactatcagaagatgtaccaactgaggcattatgctccgtataagtattattttcactagtcaatccttctaaaaattgatagtcatttgtatcagctaatgcgccagtctctttatcaaaataaagtaccttaccatcaattacggtagcaaaattcttttttacttgatcatcatcgtcgtaataatatgttttgccatcaatcgttttcagattctttgaactagcttctaatgctgcagtagtatcggccgtcttcgaattgttatcaatcgtttgacttttttgtgccgatgaacttacatctttatcgctcgctgtagttgctgttttatcatccgttgatgtagccgctgttgttgtagccttatcatccgttgatgtagccgctgttgttgtagccttatcatctgttgatgtagctgctgttgttgcagctttatcatctgttgatgtgtctgctgttgttgcagctttatcatctgttgatgtatctgctgttgttgcagctttatcatctgttgatgtatctgctgttgttgcagctttatcatctgtcgatgtagctgctgttgttgcagctttatcatctgttgatgtatctgctgttgttgcagccttatcatctgttgtgattgatttgtcagacgtagtcgcatccaaattcgattgatcgactgccgtggccactactaccccattgttttgtgaaacatcagcttgtgcttgttgaataaaactggtaacaccaattattgaaacactccctgcaatgactaacattttcccagatttatacatctttttccggaaaacgcttgttgcatttctatttctcatttacttcttcccttcattctttccctttttggcacaaataactactatattctctaatcaaaacggttatttgtgcttgtgagatcctaaacatttatgactaagaatgttttgtcaacaaatgttttttacaaacgttaatcattaaaactaactattttaatatataatgaaacaaatatttaaaataaattatgcagaattgaataattagaaaatattaaggttattttaatatataataagtcactgcttttaaataaaatataaaaaattaaataattataggttactgaggatatgaataataaaaaaggatctgttatcaaagaaattaggaaaatacgaggaatatctcaacaacggttgggtgttttaattggatcacaatcaatggtgtctagaatagagaacaataagacagaaccaactgatcacaccatacttttactgtgtgacgccctaaacatttcattcgaagaatatttttcggccgtttttggaaaaaaaaaaacaacttaaaaaccctgacaactgttttaagtcaatattatcaagacaatgatcgtcaaaaattggatcaattaacgcaattattacaaagtgatacaatcaagaatcctagcgacccattcatgcgtcattattatttaatgtcgctgtctactttgtatcacttagatttcctagtcgcatcaatcgacgatcagaatgaattgattgattacttttttaatattagttattggcagttctatgacttatgtttactggcgaatgtagttaacatgatacatgttgaaagaattacaccttacatatctgacatacttaaacagtacgctacgaataatattccaacggcatccgttgaaactgtgagcaaaatattgattaacgctttggaaacaagtattatacaaaaaaaagatgactttactagatacctattagataaaattaaaaaatataaatttaacaccgatgactttaagtttcaaacgtggctactattttggactggggtgtttgagaataataataacaaaattaggcacgcctatagtattgctacgtacctacatcaaaatattactttaaaaaattttgataagtttttaacaattactcaaacaccaagtcctttttttgaagacactaaaaaagacacacctaaaagctaaactcttagatgtatcctttattaactaattattataactcttgttggaaatccattggtgtataaagtttcaatagtttactaaacacaaattgtgcaatgaatcctgcaatgatgggaataaccaaccatgccagaactgcaatcgctggattaatgaagtgattcataactgttgaaggtacagtaggatctttgaccattgattgaattggtgataccaatccaatataaccaaatccagctgttgttggtgttccttggatattaaacaacgcaactggaataccagaaatcgcggctgctaacaagaatgatagcattgtcaccggctttgcaaagactgatggcatcatacctttcatggcacctaatgcaatagcaactgttacacctggcttattgactttccatgaattaatcaaaagcacaatggttgtagcaacaacacccatggcagccgcaccagatccaattcctgatagactaattgccaaagcaattccaacagttgaaactggtgtaataatgataatggcaaaagccattgcaattaacattgccataggtataggtgctaatttagtaaatgtttcaactaattgaccaatccaagtagtaacatccccgacataaggcgcaatcattttaccgaccaaaccaacgccaccaccaacaaggataggacttaaaataatagcaactgatccaaatccttttaggtagcgggcaacaagccaagtaacgaaaaccgcaatagcggaaacgatcattgcattgatcacatcaccagcaccagatgctatataaacgttagcaggtgctacagagttgaggccagtcactggattaagccaccccttgggtgcgacggcccacttgattgatccagaagctacggctgtcgctatcgcaacaacaccaacatctaagctcttcattttgaactgtaaagcaaccgccataccaatcaaaaatggaatcaatgatgtgaataacgttaaaatagcactcaaattagcgccaaatgccgtagtacccagacctgaatactgaatgatgtacttcataacagctgatggcaaaacaccaattaaaataccttgcgctgaacctgacaaaaccttaaaaaagaaatctttcaaacgtaaatcagtttgaccactaaactcaacgggggcattttctttcgctttacgtgcatattcttcattacgcaaatcctgcgattctttggcagaccacttctcgccttctgctttgatagacatactatcatttcctcttttcaattcatatttgtgacacatccctcactgcgccacactctctcccaaaactacgatactataatcaaaattgtttgattattctttcacaaacccctcggataaaaaattcccaaacactgaatctgggaattccatcatattaatattcaacagcaatagctggcttctcacccttggcgaaagcaactgctgcatcaaatgattggtgaaccatttctagaacagctttagttgtatagaaagccgtgtgtggcgtaaccaatacattttcacgtgcaatcaagtcagcaatcttagcatctgggaattctttaccagaccaatcttcattgaacaagccaacttcattttcataaacgtccataccgaagtctgaaatcttaccagaattcaaaccatcaataatagcgtcaatgtccatcaaattaccacgcgcagcgttcatgataaccacaccatccttcatcttagcaatagcatctgcattgattagatgatggttttcaggtacaccaggaacatacaatgaaattgcatcagcttgtgcatataattcgtctaatgtgtcaacgtacaaaccttctgcttgtaattcagcatttgggtacttgtcataagcaataaccttggccccaaagcctttcaaaatgttaatagcaacacggccaatatgacctgtaccaataacaccaactgtttgcatacgcatttcacgtccaattgttggtgcccaacgcaagtcgtgcttagcaattttggcatccaatgctttcgtgcgacgtagcaaacgagataattgaatcattgagtgttctgcaatagcatttggtgaataaacaggaacatttgaaatgttaaagttaaattcacgtgctgcatcaaaatcaatgttatctgtaccaacgttacgcaatgacaagttagtaacaccaacgttagctaaagctgtcaatgtttcacgtgtatagtccaattgttgataaacaacagctgaatctgatccctcagccaacttagctgtttcaggtgtcaataattcttgtgtgtagtccacttcaatctctgggttagccgctttccattcttcaagtgatggcttttcatcatcacgaatgccgtaagcaaaaatcttcataagatcctccaaaattttatttcatctataattgtaccctatttcacgagctaacgcacgcgattaagcccatataatgcatagatttcagaaaaaatttcaccccttacaaatgacagtcgttaagcaaatgtaacccattccattttctttactttaatcactaattaaagcactttctactaactataacaatatgcctactaataaagtaaccagcatccccataaaaacgacaactaaatttttaatagctaaaatgaatgtctcttttttgacaggatgattcacgaatgcacgtgcatttttgataataatcggtagtaaaattaataaagtataagaagttgttggcaaccagccaactagtgtcacgagtataatttcaacaaaagctaaaattgcccaaaagacatatatttttttcgcatttttaatgcctatgtagtgaactaacgtatgtcgatcatttgcttgatcctcatcataatcagcaatgttattagcaaacataatctctgcaataaaaatagtcaatggtaaactgacaataaaccattgaaacagtacattccctgtcggcaccatgcgtgtgtttacatatacttgagccacgaaaataaaatagcccattgttattccagatacaatttcaccaaatggtgtatttgtgatcggttttggtccggcagaataaaaataaccaattaaaaaactaacaattccaataatccaagttatataatccgttcgtaaagcgacaataactcctgcaagcactgctatcaatgccaggccttctgcaacatgcaatacttgtttatcagtaattgcttcaacatcatcagactccctcaaaaaagagttctctttttggcgtttattatcctcataacgattgaaagtattaacggctaaatgtactgcaaccgtcgcaataattaacaatagtgtattcacccaattaacacgagcatactgccactggctatatgctaaaccaaccaatagtggtgcaatactcggtacaacaacccgaatctccaccaagtctaaaaactgcttatatgtcatcattttataaatcctctgacatttattgtatcagaaaacaaaaaacgacaccgcatcgtgtcgttacaataaatgttaacttttgaattagtgtgtactatcacttactttcatacggtgttaagcgaacttttccgtcgatgtactcgccaacgaatatgtcattaatactgtcataaccttgattttgtacaatatcagttaaccatgactcatcacgatcaatgatgtccaatacatccatgttgatttgcccatcaaatataataggatatttcatattctcctcaccggctaagattactgtcagctgtccatttatttcaagcacagctcttttaacttgagacaaatcatagacactttgtgatcgcaatttaaacattaaatcattcgctgataagccagaagacaggacgtttttgatgttcacttttcctcgttcaatgacaaccttaggctgaccatcaattaatagtttaacgtaacgattatgttcttttaaaaacttgaatgtcattactaacattgtccaaataatcaatacaatcgtaaattgaaaaactgtgatggtgtctgagtaaataactgcgccaataataccacccaaaacataattttgaacctgatctaacgcgtttgtcggtgctaagttgccctttcccataacattaatctgaattattaaagctaccaacccaattgctagcttagttaatatgggtagataaatactcatttgaccaccttcactttcgagttaattaggtatgcacgtgtcaggctataagactgttgatcagcactaattgtgagccgatagaactttttgtccatttttactaacataccatcactcactgttgtcgaattaaaatataatttatctttagaaacaccttgcgttttggcaaacttagttacaaaagcagccatttgtgtcttctgatcgtcctgcgatttagcttgctgataatctgtatatcgtgcaccagctaggaataaaaaaagcaacaacgctataatgcttaattcgcgatagcgagtttgcaaacgatttctaactgaagccaccgcaccgactgccatcaaaacaaaaacaacaaccattaaatatttaccaatagtgtcgtttatatttgtttgttttattaaatagtcaacggaataaaaattcatctcaaaatacctcgttaattatcataccatatctctaaaaagccattgaatcgaattcacaatgcttgaagcaactatcaaaaagcgatatattatttatattatactcatataaataaaaggagctgctatcttgtcaacagaaattacaaatcaacaaattaaagattttcgtacagcaacagacgataaacacaacaacattattcgtcgagctgttaccaaaaatggtattcacagcgcgagttttgaccaagagattgcaaatattaacacaccaatattctcaattgatctagacactggaaaagttgctaaccaaaagcaatcggggcgttgctggatgtttgccgccttaaacacgatgcgccatgatattaaagataggtttcacattagtgatgaatttcaactttcccaaagctacacgttgttctgggacaagtttgaaaaagccaattatttttatgaaaatgttctcaaaacggcaactgagcctcttgactcacgtcgcgttgccttcttattgactacgcctcaacaagacggtggacagtgggacatgattgtctctatcattgaaaaatacggtctggtgccacaaagcatttatcctgaatcaaaagcttcttctgccactacagaactcaacaacacgctcaatacgcttctaagacacgatgcaactgtcctgcgtgggctagtggcccagcaagcctcaaaagacaagatctctaatgcacgcaatgaaatgttagctaacgtctaccgcttgttgtcactaactttgggtgagccacctgttcaattcgactttgaataccgagatgagctgcacaacttccacgttgaacgtcaattaacaccacaggattattaccaaaaatttgttagttgggacttagatgagtatatttctgtcattaacgcaccaactgctgacaaaccatttgatgccacttataatgttaacatgttgggtaatgttgttggtgggcgtgacgtcaaacaccttaatgtggatatcaacaaaatgaaagcattcgccatttcacaactcaaagatggtcaaagtgtctggtttggtgtagatatgggtcctcaagttgatcgagagagtggtctcatggccagcggtatttttgcttccgatgatttatttaacgttgactcaacgatgaccaaagcacagcgtcttgactacggcgaaagtctaatgacacacgcaatggtcttgacaggtgtagatttagatgaaaatgaccaaccaacaaagtggaaagtcgagaattcttggggcgagaaagttggtaagaaaggctacttcacaatgtcagacgattggatgagcgaatatgcttatcaaattgttgtcaagaaggaatatctaagctcagaactagtcaatatttatgataattcaaagccaacattgttgtctccatgggatccaatgggtgcattagcttagaaaaagatgaggcgtcaatttaaatatgactctaaaagaacagcttcttcagattaaacaaaatagcccttcgattatttctaacaaactactttttgaaatggttgaaaacattggctcgttagattctgaattacgagacacactcatctacagtctcttttctgactggactacaactgggaagttatcagtaaatcaagaacaaaaggtgtcgagtttcttgcttgataacagttatctattacaaaatatcgataataaaaacgataaactaagtatctttactcgtagctttgcagcactttttctagcctcactatcataccgtcataataatcattcatttttatctcaaagtcaacaacgtcagattattgaacaaagtattgattatattcagaacgaacatgattttcgtggtctaacaaatgatggttgggctcatggcattgcccatattgcagatttgctcgatgaagttgttgatttcactacttttacacacaatgacagcatccttgtcattaacgccatcaaaaatattttacacaattcatttctattcacagctgatgaacctggtcgaatggtcgttccagttctgcatttgattaataaaaatataatatccgatgatgagcttaataattggattactttgcttaatgacctcaaagttgataacttcaatgcttatagtaatgtttcacttttcatgatcaagttacaagcacatttattaatagcgtacccagattcgaataaattagtttcgttagtcaattgcacaattaaacaaaattaccagcgtttcaaatatatataaccaaattctttaaaaaataaggaatacaaaaagaccaatctattacaagatcggtcttttaattttactaataatattacatcatacctggcataccaccttgtggcatagcggctggtgcatcatcttttggctcttcagcaacgacagcttctgttgtcaacaacaatgctgaaacagaggcggcattttgcaatgctgaacgtgttaccttagtagggtccacaataccagcggcaatcatgtctacccactcatcagtagcagcgttgtaaccaaatccttctttttgttccttcaacttgttaacaatcactgatccttctaagccagcattttcagcgatttgacgaacaggtgattccaatgctttaataacagtattgataccagtttgaacgtcgccttcttctgacaaagctgaaacagcagcaataacattcaccaaggctgtaccaccaccggcaacgaaaccttcttcgacagcagcacgcgttgcattcaaagcatcttcaatgcggtacttacgttctttcaattcagtttctgtggctgcaccaacgttaataacagcgacaccaccagccaactttgcaagacgttcttgcaacttttcacgatcaaaatcagaagttgtttcagcaatttgttgcttgattgtgtcaacacgagatgcgacagcacccttatcacctgaaccttcaacaattgttgtgttatcctttgtgatgttaatctttgaagcttgaccaagttgatcaattgtaacatccttcaaattcaaaccaagatcttcagtaattactgtaccgccagttaagatagcgatatcttccaattgtgccttacgacgatcaccaaatcctggtgccttaaccgcaacaacattgaatgtaccacgcatcttgttcaaaactaatgttggcaaggcttcaccggtaatatcatcagcaatgatcaacaaagcacgtccttgttcaacaacactttgcaatactggcaaaatatcttgaatgttaccaatcttcttatcagtaatcaagatgtatggattatctaggttagcttccattttgtcattgtcagtcaccatgtattgtgacatgtaaccacgatcgaattgcataccctcaacaacatcaagtgttgtttcgataccctttgattcttcaatggtgatcacaccgtcattaccaactttatccattgcttcagcaatcaattcaccaacttcttcattggcggctgaaattgatgcaatttgagcaatttcatctttagtattaactgtgtgtgacatttcatgcagctttgcaacggctgctgcagttgctttttcaatgcctgttcgaatcccaactgggttggcaccagcagtcacgttcttcaaaccttcaccgacaattgcttgagtcaaaacagtagcggttgttgtaccatcacctgcgatatcatttgtctttgaagcaacttcagcgacaagcttagcgcccatattttcaaaatggtcttctagttcaattgctttagcaattgttacaccatcattggtaatggttggtgcaccatatgattgttccaaaacaacattacgaccctttggtccaatagtcgttttaactgtatcagctaacttgtcaacaccggccttcatctttgcacgtgcatcttctgaaaactttaattctttagccatgatttaaatatctcctttgatttgataattattcgacaactgcaactatgtctttttcgtgcaatgctaagtaatcttgcccttcaaatgacacttcttgtcctgcatacttatcaaacaagacttcatcaccgactttaactgtcaaatcacggactgtgccatcatttaagacataacccgtacccgcagctacaactttaccagtaacaggcttgtccttggcattacttgccaaaacaatcccaccgacagtttcttctgcagcttccgttacttcaataatcacacgatcacccaatggcttcaacatggattcatacctccgagattttcttttttagcactctttaaacatgagtgctaattacaattttaagtataacactatcatcaaaaatgtcaacaaaaaagacgtgatctagttgtcacgtcatcaaagaaaagtccctccatgcgcctcagaaatatcataagcgatcgtaaaagcctccggatcaacttgatgaatgccacgcaaaaaatgattatactcatgattatcaaggaccaccatcaacatttcacgtccatcacccatataaccgccacgaacatccataattgtgaagcccttgtcaccatcgagcaaatattttttcaaatcatcaatgcgatcatttgttgtaatgtagaccattttacgacgatccaaaccagtttcgatatagttcatcacaaccgcagtaataactaatgaaaaaagcgccaaaatcagtgcttctaacccttgcgttaccaagttccctaacgaaacaactgtatcaattgccagcagagataaagctggtgaaatgcgaaaatacttcttaaaaatcatcggaggcactgcagttccaccactagaagcatcaattcgataaagcaatgctacaccaacagcaaaaatactaccaccaacaagcaccgcaaaggttcgatcttgtaaaacttgaaaacttggtgtaactttcaataacaccggcaaaacaatactgccaaaagcaattcgcgctgtggtaccacgatccaaaaaaacagctgccaaaacaatcataatcaaattgacgatcaacacagtagctgctcgatcaaaacccaccaattcgttaattaaaatagccaatccagttgcgccaccagcagcaacttttgccggtgcataaaaaaagttaatgctgattgctacgatttcgagtgccattacaataacaatataacgtagtgcttgatagtttttaagtattttcatttaatatcctcattgtttgtggcattcatttatttgcgtttgaatcgtgaccgaatagtatcccataaggatgcagttcgtaatattttgtcgtttcctagatgctcacgcatcactttaagtaaactgcccgacgacttagcagaaaaatctaaatcaattttatctgttttaattttaaatcggcgactaactcgattccctgtgacgtgtacgtagacagcgcttatgtttttccaaggaatttgaatataatcttcaacattattatcattaaagaactcgaacgcctgatctcctactaaaatcttaccatacttcgccccaatacctagataagaaatgccttgcgttgtatattctgcttttgcgtttaaagactgtaccatgaatatgttcccctattattttctatgtaccattaaaagtgcttgccagattgacaagcacttttaacatgaatgctattacattatgtttaaggcatgcattacgataccaaagataaagataccaataatcataacgattggtgatacttttttcttcaacaaccacattgccaagaatgtcagtaagagtcccatcaacccaggaatcaaactgtctaagttactctgtaacgtattaggggctaactttgtcaatgataatccggaagcttgctcacctaagatcttctgcaactgtgcgccggtaacattcccattcgggaaattaatgtaggcaccctttgccaacttctttgctggcagttcaagaataaatttgatcgatacccagcgctcaaccaagacagccaagatgaacataccaagtattgaagcaccctttgtaatgtccttcaataacccaccagacaaatcttgcgtaatggcacttccagctttataaccaaattcttgtgtataccacaagaatgccatacgaataatgttccaaagaacaaagaataaaattggtcccagaatattaccactaattgccaatgatgcacccagtgcacccagaattggtcgaattgtgaaccaaaagaccggatcaccaatacctgccaaaggacccatcataccaatcttaacaccctgaatagcagtatcatcaattggcgcaccattggcacgttcttcttccaaagctaatgtcacaccaagaataggtgaagcaacataaggatgcgtattgaagaattccaaatggcgctgcaaggctagcgcacgatcttcttttgacttatacaattttttgatcgcaggaatcatggaataagcccatccaacgttttgcatacgttcgtagttccaagaaccttggaggaattgtgaacgccatgcaactgacatacgatctcttttagttaattcaatttttctttcagccatcatcttgcccctttctagtacttgttcaaaatgtcgccgactggatcactaccaccgccgctatttgaaccgttactgttaccacccatttttgacaagttgatgtagatcaaagcaagtgcaacaccaattgctcctaacgcgatcaacgttagttcactaacagctgctaacgcaaaaccaatagcgaagaatggccatacttcacgagttgccatcatgttaataactaatgcataaccaacggcgacaaccataccaccacctatagccatgccaccagttaaccattctggcatagatgtcaaagctgctctcactgccgcagcaggtacagcaattaaaatagcagcaggtacagctatacgtagaccttgtagtacaagtgcaaatagatgcaagcgttcaatagtaccaatttttccttctttagcagcagcatcagctccgtgagtcaatccaaccgcaacagtacgaacaagcattgtcaggaacaaaccagcaacagccaaaggaatagctgaagctacggctactgagattcctgtactagagaaatcgccacctttaaccataatgattgaggaagctactgaggccaaggccacatcaggggcaacagccgcaccaatattagcccaacctaaggcgatcatttgcaatgtaccacctaaaattatacccgctgtcagatgaccagttactaaaccaattagcgtggctgaaactagcggttgatgaatttgaaattcatccagaataccttccatacctgcaaagaaggcaatgattacgactaaaactatcgcaataacagacatattagacacctttcttaattaaacattttacatgtcaaattatttaacatttgctttcttgattaaatcaaacaagttagccttactatcattaggcacttttcgaacatcaaattcaacgcctaagtcgcgtaacttttcaaaagcggcaacatcatttttatccatagacaaaactttgttgaccattgtttttccttctgaatgtgccattgaaccaacattcaatgacttaatcggtacgccaccttctacagcagttaacacatcttcaaccgtttcaaacagcaggaatgcgtcaacaccaccaaagcgatcgtccttagccacctcaatcattttactgattggtacaatatttgcgcgcacattgttaggcgcagcttgttggatcaagctcttacgcagctcatccttggccaccgcatctgaaacaacaataatacgatttgcttttgaatcaggtgtccaagccgtggccacttgcccatgaagtaaacgtgtgtccaaacgggctaacttaatattgatgtgtccttcctttaagccaacaattttttcggaggttttagcttccgtttcttctttggcttctggaactgacttcacaccatccttagcaacaggaaccaaatacgtagccaatccagcggctgtatcttggctcaaacggccagcataggcttcaattaacattggtaaattcaaccctgcaatgatagccattttttctggattttgcttctgaattaaactagcgcggttaaatggtgatcctccccacaaatcaactaaaaataggatttgatcatcattattaaacttcgccaatgcctcctggtaatgcttatctaaatcgtctggcccttcgttaggcaaaaatgtaacaacttcaacattttcttgttcaccgaaaatcattgaacctgacatcagtatgcctttagcaaagtctccatgactggcaataattagattaaccatccggttatctccttctcattaaaatacttactatatgattataacggaacaaaacagttttgtaaacgctttcaagtaagttttttgttaccgtttacatatttaattataatcctagtttaccaaaaagtacaagctttcactttttcttacataccttgtattttcttttcataaaatagtttttcaaaaggtaaattgtgatgaaaactaatgaaataataacttacaatctagcgacattttctaaattcatctcacaaatacgtctttatttgttgttgtaggtgtgacaaaactgcgtatgagtgtcatatcaccatttaatcggtagttttttgcatcactcaaaactataaaactatcaccttttttgatttgatcggcatcaataaaaccggacccttcgatcaccgtaaacagttcataatggtgagttagttcaaacaatgatggaccgcgaaccaacaacttatctatggtaaattttgttgctactactaaacgttcaatgacagtttggtcaacaatcgtggtatcttgaattaaggtaggatctacatgaggtacagtagtgactgctatggcctcttcaatttgaagcggacgcttttcttttgtggcggcatcaattcgatcaaagtcgtagaatcgataagttgtatcagaactctgttgtatctcaagagcaataataccagcccctaaagcgtgaaatgtaccagaagcgacataaaagaaatctcccttctgcactggaattgtgcgtaataacttgtcccattctttttgatcaaccatctttttaagttcatctcgtgttttcgcatgatgaccataatatattttagaacctggctttgcatctaaaatataccaactttctgttttgccaaatttttcgtgagactgtttatcattcggatgaacctgaattgatagattttcatgggcatccaaaattttcactaatagtggaaatgcttcatcacgtccatgaccaccaaacaattctggatgatcttgccaaactcgactcaatccttgacctgctaatttcccgttaattacagtagattgtccattgctatgggcagcaattgtccaagcctccccagtgtgatcactcgggattttataattaaagtcttccaaggcgtttccaccccacatcttttcatgtaactctgcttgtaaatgtaatattgtcataatgtaatcgctttcatttttattcaaaaaaattttattttaggttaaatcctttatctttagcatactgcgtcaataatggtgttgtttttcgttcacgagttaacattcgggcattgttttctgtccaagaacgttcaatacctcgattcgcatagtattcaaccatcactttattatacgcggaaactgcctcttctagctgtacttgattatagcgatctttcatcaaaaatccgctttcaccaagttttggcttaataccaggattatccgccggatgaccaattgaaaagcccatcactgctttcacatagcgtggcaagttgagatgctcttcgtaaatttcaaaggcccctaatgcaccagccatggtcacactacctaatcccagcgattcagcagcgacttgagcccgtccaagagcaatgccggcactcacaataccaccttcaagtaatgcatagctctgtatgttctcttctgcctggcggcgctgctcattgtttaagcctattaaatctttattgtagtcaactgttacaacaaagtatcttgccgcagtttcaatatatttcatgcctaccttagtggtaatatcagcttttatatcttgtgatgtaatttctataaaagttactggttggtaattattcatattaggcccagcagttgccgcacgaataatttctgaaacctgttgatcagagaccatttcatctgtaaaggaacgtatggacatatgttgattaagcacatctaaggttgggttagacatagtaaaatcctttcatgaaaccaaataatattcataactagatagtaccataaaattatgataaaataataaaatattaattggagaaatttatgcaattcgggaagtttcgattaggattacgtacattaaagactgctctagccgttatgctaatcatcacgtcattttatttttttaatcgtccgccttttgttgcgtgtttagcggcagtttttgcactgcgagaaagttgggataaaacgctcaactttgccaaagtgcggttgatttctaacacagtcggtggtgcttttgcgctattttatttcattgttcaccaacaaacacatcaagctgcctgggtttccatgattcttttacctctacttgttattgttgtaattgttttattagatggcttcaactacaatagtggtgttattggggcaatggctgccctattaatgatttcattaaacattccagctggtgcaaccatagtttatgtcattgatcgtatcattgatactttcatcggcgtggtcatagcaatcgcgattaaccgattctggtcaccaaaaaaagcgacgtgagccgcttttttaaatacctaaatattgctcaattgtcttcaaaacgccatcgtttgtgttcacatcgacggcttttttagttactctttgttgcataaacggctccgcattaggcatcacgaacccattttcgtatttagtcagcatctctaaatcattgccattatcgccaaacaccattacttcactatctaaaacattgtagtaatcttgcaaaacttgtagtccggctgccttatccacaccttttcctaaaacatcaacagagccaaatcctgacccagttgcatgcaattcattgccaaaaatatttctcagcgcagacacatgttgatgcacttcattatttggccacacaaaagtaatacccaaaatgtgatcatcaacttgcattaatttttcaacttgcttgacgttgggataaaattgaaaaaccatttccgcgacttgacctgtcgcatggttagacacatatgttcctttatcacctgtcatgataataatgttttccgctgactccggatttttagcattccagtcaatgaccttttctaattgattagctgacaaatgtactgaatacaattgttgttcaaatgttgatacaactgcaccattggaaccaacaaaatccatttcaaagccattattaattgttggggcaaacaattgttgtagatttttaacttgacgccctgaagccgcaacaaaacgcatatcgcgtgtctccataactgataaaacgcgttcaaatctagcttgactatattcatcatttgccgttaaaaacgtgccatccatgtccgacgcaattaatttaattgacattacttgtctcctactcgtaaatactatctttcaattgtaccaaaaaagcgccgttaagcgctaatttcattcaaattgtttaagatattcttgataaccagattcatcaattacccaatctagttcaccaatgtactcagcatggggatcatggtaagcaaattcatgcttaaatttgtataatccatctgaattatcaaattcaccaatgccaccaaaatcgtactcaactttgcctaattcaagtccccatttgagcatttcgtattggatagcagcaggcgcattatgctttccaaattcacgatatgaaccagcgtacatgtaccaaatctcatcgccataagagaatccaaggccactggcaataacttgatcttcataatgcgctagataaacacggaataatcccgtaccagcccataatttttgcattcgtaagaaatagtcaattggtcgatgggtaatgccatggctcttcgccatcgacacatatgtatcaaacaatgcgcgaatgtcttcttcactatcaccacttgtaacagtaaccccgtcacgaaaagcacgacgaatatcatttctgactttcggcttaaaatgaagcattaactcatcttcatttgtaatgggcttagccccttcaccgcgaccatcatagtacaaaacaacattcttacgtggttgaatgttcccatgcatatgcttaacttgtttatttcttgttttaaatccagcatcaagatacttttgatttaatgcatcagaatatgacacctcaggatccatacgtaccaaaaatacattatctggcaaagccgtcaatgcttcattaatcattgacttaatcaagtcaatgtcctcaacatcagctactggccctcggccaacataagctaatagttttcctggtactgcttcgacggttaaaatagacatagcggcatcaatttttccgtcagtttcgtggtaaacataaatgtgtccccagttagatttcaactctccccacaatggatcttgtgttacttgtccacggggattttcacgaacgaattgctgataatcagttacttttttggaatcatctaaatttaaaatagtcatgtgaaattatagtcctgtcgtaattgagccgtagttttcgatgaaataaactaacgtctgtaattcatttgttaagtcaacgttttgcacacgaacaccagttggaacagtcacacgtactggtgtaaagttcaaaatacctttgacacccgtttcgactaactggttggtaatttcttgtgcaacaccttgtggaaccgttagaatggcaatattgatacgttgtgctgttatttgctcttgtaactcttccattgaataaattggtacacctgacaaaattgtgcctgtacgcttttcgtctgcatcaaatgccgctgcaatacgcatatttgatgattgatggaaattaaagtttaataaagcttgtccaagattaccagcaccgattaaagccacattaattaagctgtcttggtccaatacattggcgaaaaaatctaaaagcgctttgacatcataaccgtagccacgcttacctagcgcaccaaaatatgaaaaatctcgacgaattgttgccgcatcgaacttaatagcttcactcaactctgaggaagaaattcgttccttgccagcatcatgtaaaaatgttagataacgaaaatatataggtagccgcttagcagttgcacgcggtattttaggttgttgagtcataattatctccattaattaaacttgtgaacttttgcataactagtataccatatataaaaaaggttttaccaaaagatagtgatgttttcacaatgatgtcaggattgtaacaattcaaaatccaatcccggatccgtgtttaaatctaaatcagcaaaaatatttttcttgtaattccaataacccgcagcaccaatcattgctgcattatcccctgtatactgcatcggaacagggataaattctgtctttggaaaatcgtttaatagcatagtcaattcttcacgtaattgagaatttgcggcgacaccaccagctaatacaaaacttttaacaggaaaattttctaatgctcgttttgtccgaccaattaatgcatcaacaacagcattttgaaagctagtcgccaaatcattctgattgattgtttcctctttttgattggcgtgatgtacataattaattaccgcactcttcaaaccagaaaaactaaaatcatagttatcttcatgtgccatggcagttggaaatttaatggttggttggcctctatgagccatctcatcaattgtcttcccagcaggatacggcaaatttaatagccgcccaactttatcaaagctttccccagctgcatcatcacgtgtttcgccaatgacttcaaattggttttcttcacgcatcaatacaagttcagtatgtccaccagaaaccattaatgccatcgctggatatttaattggcttgttaaaatttgccgccgcaatatgacctgctaagtgattaactggaataactggcaaaccatgcgccagagcaaatgttttcgcccccattaaaccaactaataaagagccgactagtcccggcccatatgtcacagcaaccgcatcaagcgctttgggttctacatgagccgtgtttaaagcatcatttagtacccgagtaatccattcaatatgatgtctactggccacttcaggaacaataccaccaaagcgttgatgtgaattaatttgggtagccacactgttgcttagcacaatgtgaccgtcttcaacaatggcgacacttgtttcatccgcacttgattcaaaggaaattattttagtcaatttttttctccatcataattgcatcatcaccatttctataatatttttcacgacgataatactctgtaaatcccagctttctatataatgcttgggcgccaccattttgtgcagatacttcaagcaaaaatcgagtaacttgcttcatattaaaaatatgtttaaaaatgttctgtgccacaccttgtttttgataatcaggatgtactgcaacactaacaatttcagcttcatcaagtattgttgtgacaccaacaaagccaccatccccgataaaataagctgtcctgggactagctaaatcatgttcaaaaacgcttttgggccaaggggatgatccaaaagcagcatcggctatatgccatatcaagtcaatatcttcagttgttgctcgtcgaatcatcaaagtgtaatgccattgataccgcatcttcgcgattatcgaggtaatatcctttcttaatacctgtttgcttatagcccagtcgttcatacaatgccagtgcgcccaggttggacactctggcctccagagtcattgatgacacacctgtttttttagtaaacaattttaactcttgcatgagtatcgtgcctaagccgctattttgccataccggtaggacagctatattagtaatgtgcatgtcatgaatgtcagtgcgcaaagcagcaccagcaaaaccaacaatttgaccacgccgttcaatgactaaatacagtcggacatgcggacgtgacagttcactcacaaaatcacgtaaaagccatggtgctgaaccattataaactgcttcttcaatttttattagcatatcgatgtctgacatcgtagctcgccttaataaaaatgttgtcccttggacatcaacgactttttcggtatattttggcaaactatttaataaatgctttgattttctaaatttcaaaaacatagttttctggtttatcctcaccaggatgagcagcaatccagttcagctctgcttgcgttttgcgtagataatttggattaaaatcctgaatattctctgtaggtgtttcttgcaatccaagtgttacaatacccaccccatccggtaaactctcttctggtgacaaaatttttgcgcgctcaccaaaaagcgtttgcatttcatcgctaaattctgaggtgtcacccagaaaagtaattggttcgtcctttgcttccaaaaaagcaaataaatttgtaattggctgatgagattcagtaaatatactcacaccattttgatatacaccagcaaaaacgtttctattgcgggcgttaaataatggtaccactagcccgtcagctttaacttgttccgctaaaattgctaagctagatacaccacataattcagcacccaaggtatcggctaaaacttttgccactgtgacaccaattcttaatcccgtaaacgatcctggcccttgagccacaacaacacgatcaatatcttgtagtgtccaattttcagcagccacaatatctcgaatggctggtagcaactgaatggaatggttacgtgctacattggtagtgaaaacgttttttacgctattatgttctgccaaactcactgttagtggttggttacttgtatcaaatgctaaaatcttcataagtttaattttatcacaaataataaaacttgaatgagaattgttatatttattcgtaatcataaaaaccgttatagagcacaaaaaaaaacgccaatggcgctttttctaaatattactttgttgcttccttaactaactcaatcacttcgtcattcgtttcaacgtccaatgctttttcagccaacactttcatgtcagctgtattgagctttttcatcaaggaacgagtttgcaaaacagatggtgcactcattgaaaactcatctaatcccatacccactaatagtggtactgccacaggatcaccagccatctcaccacacattgcgacaaacttgccctctttgtgtgcagctgaaatcacagtattaattaatcgtaagatagacggattatatggttgatacaaatacgccacacgatcatttccacgatccgcagccattgtataggcaatcaaatcattcgtaccaatggagaagaaatcaacttctttggcaaatttatcggctaaaattgctgcagctggaatttctatcataatgcccaacttaacttcacccgtagccacacccgctttttcaagcttttcacgttcttcaaggtaaatttttttagcagcacggaattcgcttaatgttgcaatcattgggaacataatccataagttgccaaacgcagatgcccgtatcaatgcacgtaattgcgtgcgaaaaatatcagtctgatccaatgaaatacgaatggcacgataacctaagaacggattctcttcttcaggtaatttccaataatcaagatgcttatcgccaccaatgtccatcgtacgaactgtaacgggcttgtcacccatttgttcgacaacagatttgtaagcctcaaactgttcatcttcggttggtaaatgatcagattccatatacaagaattctgttcgatacaaaccaacgccttcagaaccattgtctaaaacagcttgcatatcttttggtgcgccaatgttagcaccaacgataaattctttaccatcagcagacactgatttctcatcttttaacttagcccattccgcacgttgtgcgaaataatcggctgcctttttttgataagtagcaagtgtatcggcatcaggattaacaattacatcacctgtcaagccatcaacaatgaccaaatcaccactagaaacttcaactgttgctttttcagaaccaaccaccgctggaatttccaacgtacgtgccataattgatgcatgagctgttcgaccaccaaggtcagttagaataccttttacgaactgacgatctagttgcgctgtatcagaaggagttaaatcctttgatacaagaactacttcttcatcaattagtgctggattaggcaaagaaatgttcaataaatgtgacaaaatgcgcttcgttacgtcgcgaatatctgctgcacgttcttgcatatattcattatccgtcatcgcatcaaacatactgatgtacatatctgtgacttctttgacagcttgttcagcgttaactttgtcatcttctattttttgtttaattgcaccagacatttctggatcagccaaaaccattaggtgtgcttcgaatacttcagcctctgcagcacctaaactttcggttgcctttgcctttatcaatttaacatcatcactagaagccttcaaagcatcgtcgacacgtgcttgttcagccgccacatttgttactgttgtcttctcaaaagacaaatctggatcaactaacaagtaggctttagcaattgctacgccgttacttgccgcgattcctttgaagtttttcgtcattttattctgctagtccttctgtagccattgcttcagcaattgttgtcattgctgcttcttcatcagcaccctcagtcttaatagtaacatcggctccttgaccaacacccaatgacattacacccatgattgacttcaagttaacatccttaccttgatatgacaaagtaacatctgaagcaaactttgaagctgcttgtactaacaaagttgctggacgtgcgtgaatacctgtttctgcgatgatatgaaagtcttttgattgtgccatgtttaaaattctcctttgtgctgttaatcagcttctgaatatagtttatcaaagcgcttacaaaatatcaagtagaatattgcacaaatcattgttatatcaagcactaaagctagaaatgcctatttaccggctttttcaatgaaaacgtttacattgattttgcgtcctcttttctgaaaaatagattgttcatacttgaaacaacttatatccacaataaaaaagcgttaaacatcatcagttcaacgcttttttctcacttaaaattttcatacaggccattaacaaagtctagccagtactgtggatttagaggttctcccgtagcatcttccaatactttattagggtctacagctccaccatattgccaaacattctccttacgccattcaaaaattggtgaataatctcccgattcaaagatagctttaaaatctaacgtctttgtcatggttgctctaaattgagctgcatataaatgaccgagtgcataacttggaaagtacccaaatgatccgcccgcccagtgaatgtcctgtaaaataccagtcaaatcatctggcacttctaaaccaagatattctttatatttcttattccagagtgctggcaaatcacttatatcaacgttatcgttaaaaattgctttttcaatttcataacgaataatgatgtgcagtggataagttagcgggtccgcttcagtacgaatcagtgtggcttcagtttttaaccacgcttgataaaattgatcaaaattaatatcatcaaatgttggtgccacaattgcttgtaactttggatattcaactgcccaaaattcttttgatcttccaaccataacttcattaaacaacgattgtgattcatgaatactcatgctgattggcaaaactgaacgtacatcatcatacttagaatcaacattttgttcaaagagtccatggcctgcctcgtggagaatgcctagaactgccatttgaaaattattttcgtcccagcgtgtggtgatacgagcatcatcacgattcagagcttccataaatgggtggatcgtatcgtctagccggcccttatttaggttgtaacccaatctttgtgcagccgccatagcatacttactttgttgtaccttagtgaccttacgacttaaaaattcatcgttaggtatcgaatcattggctgacaatttgtgacgcaatgttgtgataccattcttaacttggtcgaatactgcatccaatttttcgacagttaatcctggttcatattgatttaataaaacatcgtatggtgttttttcatttttttgccatagcggaatgaattgcttcaaatagctaataattcgttccaaatatggctgataaactttataatcattagcctcacgcgctcttgcccaaaaatcttgtgcttccgaaagtgttttctgaaaagcaataaaatcttgttcaggaatattctctgtcataccaaaatctttacgtgccttttgaagcacaagatgacctagactatctaatgatgaatcgtcagcttccaaatcttctaatatcttttttcgagcacttccagttgaaacttgaaataacttttcagctaaatatgcgtccatctctgcacgaaaatgtcccgcatcctttggcatccccgtcaaagcatcccaacctgaaagtgcagctatttgtgtcaaaatagtctgctctttaactgaatcaaataaatcatgttgtgtcgtcatacatagctcctattagaatatttttagttaataatcattttatcatttcatttgaagaaatgtgtcatcattgatcattatttagaaaactgtcttaattaaaaataaaaaagaaactagacctattagcagatttagttccttttatttttagttttgaaattcctgatttcccgctgctttacctaaacgattattaaaggctttaccaataccaatcggcggcatcttttgaacgtaaatcgtggttatctgactatcatcatcgtaaaaacgtaacccagcaaataactgttcagtagccgtttctaaggtatttcctaatgaccacgcctgatgattcgttaatgccattttttcaatcatatcatcttgggccattacaacatcatttggtgcaagtacttgctttaattctaaggcatctaattcgtcaaacattacgacatttttgtctggggcatagtggcgatatttcatgcccggtgccttaggtgttacattactcgcaacagattctgtactagttgcatcaatgaccttcatttgtaagacttcttcaagttgtggttgggtcactgcgcctggtcgtaaaataatcggtgtcgatattgacatatcgacaaccgttgactcaacacctacttgtgttggtccatcatcaacaattccggcaattttattttgcatatcatgccacacatgctgtgctgttgttggggatggctttcctgatgtatttgcacttggtcccacaattggtacaccagcagcacgaattaacgtacgtgccgcgtcgttagcaggtaagcgaaaagcaaccgtctgtaatccaccggtcaccaacatggacacctttcctggtttgataggtaggataatagttaatgaacccggccaaaaatggttcatcaatttcctagcttggtcagaaatagttacaaattcatccaattgtgcagcgtctgctacggtcataatcaaaggattgtcagcaggtcgtcccttagcgacaaatacctttttaattgctgattcattcgttgcatcggctcccagtccgtaaactgtttctgttggaaaagcaactatttcgccgttttggataagtcggctagcttcttcaatatcattttttgtggtttcaaaaatttttgttttcatttttctactcgaatcatgcgatcaagacctgaaaaatcttgtcgcaaagttatcttagctttaggcaatgccgcttgtaataattgctgtactgcctttccttgcttataaccaatttcaaaatacgcacggccatgttcagttaaatgtgcatctaatccacgcgcaatttttttgtaaattgctaacccatcgttttcagcaaataaggctgtatgcggttcgaatgttaacacactgtcatccatctcattctcatcactattagaaatatatggtggattactaacaataagatcaaatatcaatccgcttaatgcgctaaaaacatcgctttcaacgaaatgtagatgtgataaattaaaacgttgcgcattcatttcagctaccgtcaaagcatcttgagaaatatctgccgcaaacccttttactcggtcattctcaagcattaatgtttcgataatagccccactaccagtaccaatatctaacacagaaaccggatgtttagtattaccagcatctttcaaaatccattcaaccagttgctcggtttctggccgtggaatcaacacacgttcatctaccataaattcacgtccataaaatggtgcatgacctaaaatatattgtggcggcttatttttaactaattctgatacccaactaggccaaagtgcggctaaagctgccggcatttgtcgtgacatatttgctcgcagcataccataattaacattcagtgccccactgagaagaaaatcaatattatccttagcatcgtctgctggcataccaacactggttagctctgagatggcccattttttagcctcaagcaatgaaattttcactgtggctggattaactggctttttgatgtcgtcccattcaaaccattttggtgtatttaatttgctcgaaagtacttttggatctggtttggattttttaaactgatctggcgtttcaaaatgcttttcagtcatttgtttagttccgccaactttgctgtttgatcagcaataaccaacgcatcaataacttcgccaagttcaccgttcataatacgatccaacttattaagtgttagaccaatacggtgatctgttacacgattttgcggatagttgtaggttctgattcgttccgaacgatcaccagttccaactgctgatttccgctgtgctgcatattcagattcattttgttgtgcataaaaatcataaacacgactggctaacagcttacgtgctttatcacggtttttaatttgcgttcgctcttcttgcatcttaaccataataccagttggcttgtgaattaaacgaaccgctgttgacaccttattgacgttttgtccgccagcaccacctgaacggaaaaattcctcttccaaatctgattcatttagttcaaaatcaatttcttcaaactctggcatgacacccactgtagctgttgatgtatggacacgcccttgcgtttcggtagccggaacgcgttgcacacgatgagcaccagactcgaatttgagtttagaataaacattgtccccagtaatcatgacagctacttctttgtagccccccacctcggtagtgctttcatcaataatgctcattgaccaattttgacgttcagcataacgtcgatacatatccaacaagtccgcagcaaacagtgatgactcatctccaccagctgccccacgtatttccataataatgtttttatcatcatttggatccttaggtagcatcaatatttttaactgttcttccagttgttctttttcaggttttaaggcactaaggtcttccttagccaaaggcgccatttcagcatcgaccagcagttcctctgcatcctgaatatcttgaataacttgtttatagcgtgtgtaaacttcaacagtttgacgtatttcgcccgcttcctttgaaagcttcatgtaatgttgaccattattcatgacttccggatcagccagttgttcattgagctcatcatagtgatctataacggtttgtagtgattgaaatataggatccattttactctccaataattgtttttagtggtattcagcccaaaacatcttgtttcttatgtacaagaccaaaggtcttttgatgaattgaattatttaaccggaaacatctcagttattttatctaaatcaggcttaaaccaatgatgacgacatgtaggaatataggcttcatccccgccaataaaaacttgcgcaccttcccgttgtggcttcccatcaacaatacgcaattgcgttgtcgcttttttaccgcaaaatgagcaaatggttttcatttcctctaacttgtcagccagctctattaaacgttttgatccttcgaataaatgattgaaggcatcttgcttcaacccaaaagtcattaccggaatgttcaagtggtcaaccacataagctagctgatcaacttgtttagcagcgagaaactgtgcttcatcaatcaaaactactgctaaatgatcatctttcatgcccttgatcaaatggtatagatcatcttctggttggactgccacagcctctctagaaagaccgatgcgactagcaacgacgccaacaccagctcttgtatccataattggtgtcatcagcaacaccttgcgcccttgtgattcataattatgcgcaaccttaagaatttcaatagactttccggaactcattgcgccatattcaaagaataattgtgccatatttttactgtgcttacgagcaatcgaaaacacgattctccttttgattaacttaaaaaagtccgtgtatatcataaaaatgataatatttataatcaacattatttgtctaaacgaaaatgtagacaatactagtaatattatagcaatatttacgacaacaaaaaagccacgattatgtgacttgagcagacaaatctattattgataaaaatcattcgcttgtttcacgacgaaccgtccctggcttcaacaaatcggcccatgtcagtgttttagacgttttataattgaccaactcatttaaacggctaatggccacaccattagtgggcgatgaatcatgcagaataaaaccattaccaaggtaaattgcagcatggagacggtcttcagtataggtatttggcgtcaccagcacatcactacgctgcatattagaccattcaacttctgtaccagtttgtgctaataaagttgttgacgctgctgattgcacaactaacggcaaaccagcctttcgataaaaccaagcaatgaaggaagaacaatcaaattcatttttagctacagaactatcagtacgaccgccaccataagaataggggcttttgccaactaaagtcataccacctgaaataactttttcaatggtttcattgtcacttttaacagacgcggcaatttttttgtatgctgtgacagaattattcacgccatttttatcaaaataataataatagccatcaatttttttcaaaccatataccatttcaccagtttgaggtgaaaagtagtattcttttttgccaatggtttgtagtccagtcaatttctttttagttgtatctgaaatcaaaaatgttttccctaaggtagtcgtctttaaagtaactttttcaccactaattgttgtgaatttttgtgatgtgctcttcaatggcgttgctttcaacactttttgtggtaatgcttttatattatccggtaggttgataacgtttgttctgaccgcatacgttccggctaaactaataatgacaataggtactgccacagtccaccaatgcttacgccgtgcatgcttttttgatcttgatactttctttcttgatttcatttatcttagtttccttcataaataagcagcttaaacttcgtcttcagtttaacaaacggatcttataataagattaaataatttttgaatcctagaaagttactgattacttatgaaccaaacttgacaattcactaggttttaattgtgccaataacttttttgcagcacgcccacgatgtgaataagatacgcgaacgtcgattggcatttccgcaaaagtctgaccattttcagcttcaaacaaggtatcaaatcctaccgaaaactgacctcgttctgccaaagctaacttagttccgcctcgtccgattgcgcgcttcacttgatcatccggtgttaataagacaaataaagcctctaaataagcacttcgatccatctctgatgcatacaaccctaataaatattcatcttcttcctggatagatttaagtcccaaacttttaaattcgcgagcaatagttaatccaaatctggctgggaaagcagcaaaatacgcacctgtatcatcagctaaaatccattcttttggcaaaaattgcttaataaaacgtgccttggctaaagcattttcatattgatcatcagtagtttcttctggaaaagttttttcactcattatcgagcgataattgaccacttggacgccaaactcagcaaatacttgttgaatctcccgtgttttagctgaattgttagatgcgattactatttttttcattatgacacctttccaaaataaatccacgctactatattattgtagtcagcagattatggctgattttccgtctgttatctcgttttcattttaccatgactagggaagaatgttttagttaggctgttaccctactgtaaaacatccttcaaaattaaactttacaagtatctatgcaaacattgtatgaaattccccaccgcgcacttgttcatggtaaaattagaatcatgaaagtggggatattatgacagttaaaagttcaattgcacgcgtcacagcaaaaacttcgtactggtttttacgaaatattttacatcgtggtggaaccagtttacccggtaaactagctgtttcgattgatcctgacattttaaaaacaattcaacaagattttgatttgatcattgtcactggaaccaacggaaaaacactcacgaccgccttgattactcgtgtcttacaagctggtggctatcaagtcatcactaacccttctgggtcaaacatgattcaaggtattaccggaactttagtgacaaccaaagtaaaaaaatcacctaacggtaaaaagccactagccgtactcgaagttgatgaagccaatgttgaaaaaatcacggcagcaatccaaccaaaaatgtttgtactaaccaatattttccgtgatcagatggatcgctatggtgaaatttacacaacttacgaaaaaattgttactggaattaagaatgcacctgaagcgcttgtcctagccaatggcgattcacctatatttactcgcggtaatttcaccaacacacgtcgctattttggttttgatcacgttgtgccagcagattataatcctgatgttgcaccaattaacactgatggtattttgtcaccaaccgataattctgtactccactatgattttattacttatgctaatttgggaaaatattttagtacaacagacaagttttcgcgccccaagttaaattatcgcatcactggtgtggatcatttaacaccacgatactcaacttttagcattgacaacacaccattgcgcattgaaattggtggcttatataatatctacaacgccctagcagctttctcagtcggacgagaatttggtgtgactcctgaacaaatcaaaaaggcatttgaatcaaatgctcaaatttttgggcgtcaagaagccattgatgttgacggtaaagatgtgatcatcgttttgattaagaaccccgtcggcaccaattcagtaatcgatatgatgctcaccgaaaaagatgaattctctcttttggcgctgttaaatgcaaattacgcagatggcattgatactagttggatttgggatgctgaatttgagaaattgcatgatacaaaaatacaagccgtagccactggtggcgaacgttataaagatttacgcgtgcgtttaaagatggctggttttacagaccaagccgtttatgaagatctctcagaagtcgtgacggctatcaagtcactgccaactaaaaaagtttatattgctgctacttatacggcaatgctgcaattgcgcgaacaattaagcgctaagggctacatcaaaggaggtttctaatggctgattatgatatttctgtggctcatttatatggcaacctaatgaacacctatggtgattatggtaacataatcgccttaacctattatgctaagcaaattggtgttgccgttgattaccatttggtatctcttggggatgaatttaatgctaccgcatatgattttgtcttatttggtggaggacaagattatgaagagactattgtcgcccatgatctgaaatctaaagcgcaaccaatccaagattatattgaaaatgatggtgcattgttagccgtctgtggtggttttcaattgttaggtaaatatatgctcatggctgatggaacaaaagtcgatggtatcggtgtaatggatcactacaccaccaatatgcatgatgaaaaattgacaacgctaaaagacgagcgattaaccggtaatattgtgatcaaaaacaacgaaactggtgaaacctaccatggatttgagaatcaccaaggacgtactttcctaggtgaaagcgaacgtgcattaggtactgttgtttccggtaatggtaataatggtatggataccaccgaaggtgttatttaccgcaacgtctacggctcatatttccatggaccgattttcacacgcaacggtaatttagctaagcgtgtcttaacaacagtcttaaataaaaagtatccgactattgattggcaagcaaagttaaatgtgattgaaacagagacattttaataaccataaaaaagcaacagctgtccgaacagttgttgctttttaaatatttttgtcctgattatttagtttctgatgttcttcggcttgttgcttcttaaccttagtaacttctctatgataccaacgcataatcatgaccagacccactgttgaaatcaacatggcaatgactacccaaataaaaaatagaattaattttgtatcttgtgacattattataactaacacagattaccatacaacctgcatttttcctttcaaattgctatatgtacacaacccgatgggttgtatttaatttactctgacaaatgataataatatgttgatacagaaatatcctcacgggctgcaaacgctgcacgcaggcgcagcgaattttggttatgcaaaatattttgccatggttgttttggtacaaattgtggaattaatactgtcactgaatgattgcgcttttttgcttgtttaactacagcatccacaaagctcaaagagggcttaacaatcgatcgataagaagaatggatatcaacataacgcacatcaggaaaatctaatttaaattgggttgatgttttcaactcttttttggggttaacatcaaaactaacatgcatagccactacgtaatcaccaatagattgcgcgtaatcaacggcctccatagttaccttcgtaatatttgaaactaaaacaataactgttgcgccgtcgtaatggtgacgctcagcattatcatttttaagatattgtaaacgtaattgtttaccaatactcatataatgatgtttaattttcaagaacataaacaaaatcattggcataatgaaaaggtatggccaaacatgttcaattctcgttgcaaaaagtgtgataactaaaacggcagaaataaaggcaccaataaaattgataatcgccttaaccacccaattttgtggtttattacgccaccagtgaataatcataccagattgcgataatgtaaacggtacgaagacaccaacagcatatagtggaatcaaagcatctgttgacccatgaaaaatcatgataagcacaattgcaccaaaggccaacgatagaataccattagaatatcccaaccgatcacccctatccatataaagatgtgggagatatttatcacgagctaaatttaatgcaagcattggaaaggcagaaaagccggtgttggcagcaacagctaaaatcattgctgttgcaaattgtacaatataaaaaccaacgtgataaccaccaaatgttatcgcagcaatctgtgataatacggtcgacttactatttggcgtaatacctaaccagtaactcaaaaatgtgataccaccaaagaaagtcgccaaaataacagccattgttgctaatgttgcggccgcatgcttttcttttggtttcttaaaattaggtacagcgttagaaattgcctcaacacctgtcaaagatgatgatccgcttgaaaatgcacgcatgaacaaaaccaacgataaaccactaaaacttgtgccaatttttgcggctgcatgatatggcaattgcccagtcaacgcctggaacacaccccaagcaatcatacttaccatcactacaatgaagaaataaaccggtaccatcaaaaaattagcgctttcacgtaacccacgtaaattcatacctgttagcaataaaacaataataattgacaatggcaccgtaaaaggtagcgtagccggaaaagcggctgtgatcgcatcggcagcagctgaggcggaaacagcaacagtcaacatataatcaacaagcaatgagccaccagcaattaaccccgcttttgcgccccaattctcactggctactgcataagcgccaccacctgacggataagcatggataatctgccgataactcatgacaatagcagctaataatactaaaacaagcaatgcaattggaatttgtaaccataacgccactgcaccggcagccaataaagcagttgtaattgactcagtaccataggctactgatgacaaagcgtcagatgataaaagtgccagtgctttggttttagataatgattgaccaccctcatcaagtgtcttcaacggtttcccaatcaatgttcgcttaatattttcaaacatatcatttctctcaatacaattatttattactcaacatattctacgctattttgtgtagtaaaaaaagccgtctatgtgacgactcgatgacatttgcattgattgtctgtttctaaactttagttatatttataccacatcaagatgcaaatcgttcttcttggttttaccaagctttttcaagacatagtagaatactagtcctgcaacagttggtacaacagctccgaagacgatcattaggacaaaaccacgtggatctgatgttgccaaagcaattggggcgatgaaaccattcaagcccaacccagcgattgcataagggaccttgaagttgaagattccaacggcaaatatggctgagacacctgcaattaatgctggtccaaataacaataagggactttttaatagattagggaattgcactttgggcgtaacgatgatttgcgccaggttagcacccaaatcgttttgcttccaacccattgctgtgtacattacaaatcctgccgttgtaccaactaatgcggcaccacctgataagggatctaacataaccgcaatggccaaggcggctgatgaagccggtgtcatcaagaataggaaccacacaacagcaaccacgaatgcccctaagaatggattaatcttcatcgtcgaagctaattcttcagatacccagtttaagaatggtgtcgtgacagacgctgttgctaagccaaagaaagttcccgctaatacggcacccaatggtactaacatcatatctaatggtgttttacctgttaaccagttaccaacaagtacggccaatagcgctgcaagaacagcggaaactggttgaccagatgtcatcactagggaacctgcagcttgatcagcaacccagccagtagcagtatgtgttgctggtgaaacagctgatgtaaagtaaacagcgtttgatccaactgttgcagcgattaatgcagcacctgttgtcaggatatttgcacgcatcatcatagcaataccgacgcctagagctggtgccaacattttttggcccatcaacccagcctggattagcggtgtgtaatgaaagatatttcctattgatgccattaagagtcccataccaaggacagctaaaatagcgtttgaaattccttgtgaaacatcaaagacaacttcacttactttacgtggttgttctttcatatcacttactgttttggcctcttctttggccggtgttgtagacaatggtgcatccatggtcttatcctcctgtattatcaacaataattgctctccccataattatttgtacaattatggtaaaactataagaaaaaaggaagcgctagataaactagcgcttcctaaagtatgtcgaaaaaattcaacaactccacgccagcctttcttcaaggctggcatcaaaaagtagaccaacctcgaagtcaaataataatgacgacgttgatcttaatgacttgtgtgaagttagttgaacttaaacttttcataagagttttttccttttagttaataaaattattatgacatgacaaatgtaaaatgtcaatagtctaattaaattaatttaaaacacatttatagaaaatgttttatttttataaacgtaaaccatttcctctaattttagatataataggtaatacaattacttagggggaagttacatgaatctactagaaactattcagaaaagaataccttatcgttatggtgttttgttagcgatcattcttctgatttttgctttaaaacagtttatgtctttactgttattaacaattatattttcttacctagctatgagtgttgctaagccattagctcattttttgaaaatatctcgggctgtatcaattgcgttagtttacattatttttatcagtgtcgtgtcattagccatccaacacggtgctgctacgctaattgagcaaatcaagagtatgattactttggccatgaattggaattggcaagacaatgcactgttgcaagatgtatacaaaaacgttaatcaatatacttctatgtttaatagtaaagatttaatttctgagagtttatcacaattaaatcatattggacacgtgatttatcaattagtgttagctttactatttagttttatatttagtatgacttatccaaaattacgtttatggagcatgaattttttacatagtccattcaaaaaattttttggtgagttttatattatcgtccaccgttttattattattttaggtaaattgtttgagatccaactcatcatttgtaccatcaatacagcactgatgttcttagtgctattgtcattgcatttcccctatttattaggatttactattttaattttcgtgttgggattgattcctgtatttggggtcgttatttcattggtacctttgactatcactgcttttattattggtgattgggataccgtgatcatcattgtagttgctgttgctttaatacatctgttcgagtcttacttcctacatcctcacctaatgtctcagaaaacacacatgccaattttaattatcttattaaacttaattatcatggaacatttttttggtgtctgggggctaattattggattgcccattttgactttcttacttgattttttccaaatacaaaaattcaatcattaaaaaagatgaatcgcaagattcatcttttttgttcattaaatattagcagtcctattctttaattgttgaaccgccttattgatttcataaatatcatctgggctagtacggcaacaaccacctattaaacaagcacctgcttcataccaagtgggtactagttcggaccagtttatcggaccatgatcggtaacccatctcttacttattggatcatatgtgtcacccgcgtttggataaacgattattttcttttttgtgtatggtactatattatgaagtgcttttataatattttcaggagccgtacaattcacacctatcgctcgaatttgttcattctgattaaaataagaaatcacttcttttaaagatgttccatcccacaaatgttctcccaattccgttgaaaatgacaaaaaaataggtatttttgaaaactcagtacttattaggttgacgactgctttggcctcttcaaaattaggcattgtttctaataataaaacatctacactatccttaactagacgactaacacgctcccgatgaaaatctttatattctgactgagaaagctggtagtcccccgtgtattccgcgccattcgacaagtatgcaccatacggtcctacggaacctgcaatcaatccactctcatgtttttggtttgaatcaattaaggcttccttggccaaatcaacggctaaatcaattagttcataccctcttaattgatcaccgtttggagatggtatgtgtacttgataagtatcagtaatcgccaattgcgcaccagcattaaaataacttttatgaatatcacgcacaattcctggattctgaatcaatgctgaggctgaccataagttgttattaacttcaacatgctttttttctaattcacttcccaaaccaccatctaatgttacaatattattttcaataatattatctacttttgtcatttatcaacaacctgccttattttagaatttgctgttttaactaattggtgtttcggccaccatttaaaacgaatatagtaataaacatagacacccaacacaaatggtattgaccagattagtgcatctctttggttaggatcaaaaattactaaaatgacagaaagtgatgaaccaataaaaccagctaatggtaatgctgggtacgcccatttaggataccgcagttcattgatacggtcttccttttttaaaagccgatagtacttgaaatgtgaccacgcaatagcaatccagacaaacacgacagccaaaccggaaatcgaaactaaaattaaatataacgaacctgcagctacaaaacttgaaaagagtgccaagaatccacctgccaaacttgctattagcgccgcaacaggaataccatttctattggttctttcaaaaactggactgattaagttttcatgactcaaagaccacaacatacgagttgatgcatataagcccgaattagccatagacaatatacccgtcaagataacaaaattcataatatcggcagcgtacggtactcctaccatactgaataccgtaacgaatgggctctccgtcagaccagctttttcataaggaataatcgccgctagaatagtaatactgccaataaagaatactacttgtcgccaccaaacagcttttatggcttttggaatggctttttccgggttaacggcctcccctgctgtgatacccattaattctgtaccactaaaagcaaaattaacagctaacatggttgtaaatactgcaccgatcccattaggaaatgcaccatgactaaaaatattctgaaaaccgactggtgttttcgtatttgtgtgcacaatacctgttaaaatcgacacgccaataaataagaaaacaataatagctacaactttgatagctgctaaccagtactcactttcaccaaatatttttactgagaaaacattactgagtaaaataataagaataaataaacctgaaaatgcccatactgggacatgcggaaaccaacgttgcataattattccagaagccgtaaattcagaccccaatgcaatggtccatgttaaccaatatgagatggccactaaaaatccagttgctggaccaattaacttttgagcatggtagtgaaaggcgcctgtttgtggcatagctatagatagttcagcaacacttaacataatcaaataaactagagcagcgccgatagtataagctaaaattgtacccaatgctccggcagtatgaattgtgtaagctgaggataaaaatagcccagttccaataccactggctaaacctatcatttgtatttgtcttgcactcatagcacgttttaatgttgtcttcgtcatgaatattttccttattataaataaaagcttctgtaatgtaattttattgttaaaccataaggcgttcatcaagattagttcattgctgttttaccgatttttttaatcatcacttaactactagatatctcagaaaagactaaattacgcgcatcttccagattttgcaatgcttcaatggtttgcttttcattacgtgttttcaaaccgcaatctggattgacccagaactgattatgatcaataactttcaagccacggcggatattgtccgcaatttctgcaactgaaggaatacgaggtgaatgaatgtcataaacacctaacccaatttgcttatcataatgtgcatcttcaaaagctgaaataatttcaccatgtgaacgtgaagtttcaatggaaatcacatcagcgtctaatccagaaatagtgctgataatatcctcaaaatctgaatagcacatgtgtgtgtgaatctgcgtctcatcacgcacaccggttgtggtgattttaaatgaataaattgcttcgtccaaataatcttgccaattacgttgtttcaatggtagcccttcacgcaaagctggttcatctacttgaataatcttaataccagccttttccaaattaataacttcttgacgcaaagataaggcaatctgattctgaactgtagcccgtgggatatcatcacgcacaaatgaccaattaatgattgttaatggcgcagttaacatccccttcacgggtttattagtttgtgcttgtgcaaaagctgactccttcacagtaatgggctcaacataatcaacatctccaaaaataactggtgggcgaacaccacgtgagccataagattgaacccagccattttgtgtggcaaagaaaccagccagtttttgtccaaagtattccaccatatccgtacgctcaaattcgccatggaccagaacatctagatcaatatcttcttgtagctgtatccaacgcttggtttctgattcaatgaaatcattgtattgttcatcagacagttcacccttacgccaggctgcacgcttagctcgtacatcggctgattgcgggaatgatccaattgtagttgttggcaacaatggcaggtgcaaactggcttgttgcttcttagaacgttctgcatactttgaatcgcgctcgaaccgttcttgtgataaatgttgtatggcttcttgcactactttgttattccgagcttgtgaactattcaatgcctccagagcagcggcattctgttcaaatattgccgtcacgtcatcgccattcaactttttagttaaagcaactaactcttgcactttctcgtcagcaaatgctaacccaccaaacagttcaggacttgccttagtttcatactttttagtaatgggtacatgaagcaacgtattggaaggctgtaaccatagttttggtgctagcgtacgtagttcttcagcaaaattagctttttcttgcagattagccgtccaaacgttgtgcccatcaattattcctgctgctaatattttgtcttctggaaatccaaacttgcgaatattatcgaaattttcaccgtgaccatgaacgaaatctaatccgattgcttggacgggtaatttagtgactgcctgataaggatcaattgaatcaaaatacgtttgcaattcaatgtttaattgcggtgccacctcattcaaatactcagtagcacggcgatatggctccacgtcagcttcatccgctactttgactagcgtgggttcgtctagttggacccatgtcacaccagctgcttgtagttccttaaatacttgtccatagagtggtaaaatttgttctaataattgattaatgtcagatgaagcagatacatattcgcctctcaacttaccaagcttaatcaatgtcacaggaccaacaatgacaggcttaccattgacatctaattcatctttagcttcctgccaatactttagccagcgattttctaacaaacgtggggttgtattatcaaattcaggaaccgtgtagtgataattgatattaaaccactttgtcatatctgcagccacattgtctttgttcccacgagccactgcaaaatattcatctaacgttaagggacgatcataactaccaaaccgagtgggaattaagttaaaagcagctatcgtatctaatacatggtcgtagtttgaattgtccgcgacaggaacaatatccaaaccaaattcaatttgtttttttaaattaattaaacgtagtttcttagcagtttcattaaactgcgcttcacctattttaccttgccaataagattcaagtagttttttccactcacggtgttcgcctagtcgtggataacctaagtttgatgattttactgtatttgtcatgtttttctcctcgttttaaataagctggtaattgacaaataacttcatttaaaccgatcaacagaaccactaccggtaagaaaaacagccgttagaattttattagcatgcaagtaatagacttttcgacatgttactttcatgagcttcttctttcgtttattgcatcaaagcgttaatatttttgattgaatgtgcctattaatttctggcaacattatcttcaaaacatttggttgattcatcgcatacaaatgaataccgtcaaccccatgatctaacaaatcatggatttgctccaatgcatattcaattccagcctgttgcaaggcttctggttgatcttcatatttatgaacaatctttgccaagcgtgccggtaaagatgaaccaatcatataagtgatacgttcgacttgcgcacgactaatgataggtaaaataccagcagaaactggtaccttaatataattttccttcagtgcctcttgcatgttatagaaaacgccattatcgaaaaatagctgagaaattagaaattctgtaccactaattactttttctttaaccccagttacactaattcctgtcgttggattatcaacatgtccttccggataaattgctgcaccaatatcaaaccgtccgtcttttttaatctctttaattagatcttttgcaaacggataatattcattcacataatcttttgtcggtgtgtcaccgcgaagtgcaaatatgttttcaacgcccgctacgcttatcttttcaagatttccctttaaactactcggtgtttggttaataccagtgagattgtgtaaagctgttataccgcaattcctttcgatatattccgcaatctctttggtccttttatgattactaccgccgcctgcaccgtatgtcacactaatataatcaacgccagtttcttttggatttacttcttgtaacgttttatacaaagcgtgtagtccatcttctgtttttggcggaaatatttcaaaagacagcactggagctgacttctttttataaatgtccgtaattctagtcatagatatcctctcaatttttactaccaaatcagtgaaaattgagttaatataaccgcatcaacggccccactgccatttaaataaactgccgtcgtcattttatcagtgtgtaaataataaattgtttgattatttacgcgcacaatcttctctccttgctaattaaactcaccttagcaaactctctactcttaaaacataaaaaatcccgcaatccgaaaaaattcaagattgcgggacgattcctcgtgttaccacccgttattcgtatgctttgttgcacaccttaacttcagtcttccaatacaggattagaaaaccaaaacagctataacgggctttcccggccatagtttacgtcgctttgatttcaaaaatcataccacgctcactaaagcgaaactccaagaccatcttcatgatatgacattacctgttttcaccaaacacaggctctctataaatgcatcaatcactacttatcttttcttcgtataaaactattcaatctttgccacaaatgaatcaaacaattcttgagcatctggattgtccatcaataacatttctggatgccactgtactgcataaatacgtcgtgagtcatcagaaaatgcctctacaacgttatctgaactcgtggcgtccagcttcaacccatctgccaatcttttcactgcttgatgatgaaaagaattaacaagtgatttttcatcaaaaatatcactcaaccaactttgacgttgcaatactaaatggtgtgttggtacataccattttgtcggatattgattatgctttactgacaaaccgtcatactgactacctaaatcttggtacaaggtgccacccagtgtaacattaataatttgcaatccacgacaaataccgagaattggtttttcttgtttaagcgcttcgattaccagcgccacttcaaaagcatcacgtcgagcatcagtttcatgtaaattaatatgtggatcttcaccaaaatacactggtgaaacatcttgaccgcctgctaataacaaagcatcaactgaatcgatgtatgccttagccaactttatatcaccaattggaaacacgataggtagcgcattcgcaccgctaataccatcaatataatttttttggatataatcgacataattggtgccaaaatgagcattcgcatgaacaagattattacttggtatacctatttttttcatctttgcactcactttgcatacttatagttctgataaccaattaaaggataatctaagtttttaaccgatgagcgtaataaatgaacattggatacttgatacaatggcgtaacaccatttaaatcattattcaacttggctgcttgttgttccaacttataacgggcgtcattggcctcatgttgctcagaaaccttgttgataatcttctcatattccgaattagtccaatttgtaaaattaattgcccccttcgaataagctatatccaagaaatcaatgggatcattataatctgttgaccatgttaaagttccagcctgaaaatcatgactctcaaaggcggaaatttcagcatttaatggcaattgctttaggttaattgtaacatcaggcaacgttgcttcaatactctgtttcaagtaaacacctaatgccttataagcatcggtatcagctgtattaagcgtaattgtaattttttgttgatttaattctgattgcgcttgtttcaaatacttttgagccaatgccttgttataaggtagtgacaagttcgcattgaaatctttaccgtctacttttacttcaccacttggcacaattgatttggcaggtgttgaaccatcagccaacgctgattttgttaactccttgcggtttattgctaaactcaaagctcgcttgagatttgtattgctgactgtcttatcatcagcattccaaacaataaacgccacacgtcccttttgtgttgatttaatatcagtagcatggctcttcttcaaatccgttaaaataccaccagatatttctgcttcgtcgaccttctttgctagatattgtttagaagctagcgttgcatcagtgacttgagtagccttaatggtatcataatgaacatttttagcgtcagcataatacttatttttgacaaattcccaagtcgtcgatgattgattccatttttttatcgtataagcaccatttgagacactcgtctcagctgtttggccatacttgctaccatactcttttagtttatctgaattaattggatacagttggttagccaatataaaattaaaataagggactggatgagatagttcgattttcaccgtgtatttgtctggtgcactaataccaagcttattaacgttttctttattattatatacagaatcataaccagcaatatctttaaaatggttagcacgagtagattttgtaactggatttacttgacgtttaactgaattaacaaaatcagatgccgttacttgtgagccatcagaccacttttggttcttcttgagcttaattgtataaaccttattaccttgggttggttgaactattttttgagcgacccccggaataattttgccattagcagatgttgtataaagcccctcaagtgtttgcacttctgcccaattcgcaccaacttgatcagctagattgggatccaatgttgagatgttgttttgaacagcaactcttaacgtatgacctttcgctgattttgacggacgtgttgcagcataaatgccagcaactgcgataacagctactgcaccaatgactatttttttattcatattctctcgctcccaaatacattaatagtgtcattttaacatgcctatgacttaataaaagcaataatcactatcaaatgctgttaaatctctcccatagtagtaaacactacttatttaacatatgataacgcttcatctaaagcgttaattaaatcatctacattttcaataccaattgaaatacgtatcaaatccggtgtaatacctgctgcttgcagctgctcatcatttaactgggcgtgtgttgttgattttggatgaataatcaaagacttagcatccccaacattagccaataacgagaagatatctaagttatttatcaatgtttctgcaccagcttcgccagcttttaagccaaatgtgaaaatcgatccaacaccgttcttaaagtatttgtcagcgagtggcttgtatggagaatcatctaattctggataactgacccaagccactttgtcattattattcaagtaagaaacaattttacgtgtgttttctacatggcgctcaacacgcaaggatagtgtctctaatccttgcagcagataaaacgctgattgtggtgataatgttgcccctgtatcacgtaaatgttctgcacggattttagttacaaatgcgccaccttttagatcagaccaaacaataccgttgtacgatggtgttggcgtggtgaaatcaggatagcgtcctgaggcctcgtaatcgaaatctcctttttcaatcactaccccacccaatgttgtaccatgtccaccaataaacttagtggctgaatgaacaactacatcaatgccgtattccagcggacgagtcaaaaatggtgtcgcaaaagtagaatccacaatagaaataataccatgttttttcgcaattgctgcaacggcttcaaaatcaataatatttatttttggatttcctaagctttcgaagaaaataacttttgtattatcttgaatggccttttcaaaattttcaggatcatctgggtcaacaaatgttgtatcaatagataatttcttcaatgtttctgaaaacaactcgaccgtgccaccatatagcgttgatgcggcaacaatatgatcgccagctccagcaacattcaatattgcagcggtaattgccgctgcaccagaagctaacgatatagccgctgtaccaccttcgagcgctgcaactcttgcttcaaaagctgaatttgttggattggttaaccgcccataaatattgccagcatctgttaaagcaaatcgcccagcagcttgtttagcatccttaaagacaaaagaagttgtctgataaattggtacagcacgcgcacctgtcgctgaatctggctcttcttggccagcatgaagttgtagtgtttcaaatgcgtattttttttctggattagtcatagaatattttcctcatgtaagttatttttatgcaacatttaatacaattattactgataccacattcgtgtttgcactaaaccacaaccaagaagtgtacttaatgctcgtgttgtctcaaaaaatcgattaggcgttgttgcttgcatttttctactccttacaaatatcacatcatatatgatgtattcatctatccccaaacttcatcgaggatttctttaacaagtgctaacttagcccattgttgttcttctgttaaaatattaccttcttcagtagaagcaaatccgcattgtgttgacaaccataaacgatccaatggcaaatatttttccgcttcatggattcgcttaataatgtcttccttcttttctaactcacccgttttagttgtaatcaagccgagaacaacttttttatcccctgatactttagccaaaggttcaaagccacctgctcgttctgaatcatattctaggaagtaacttgatacattttcttgaccaaataattcatcagcaaccgcatcataaccaccagaagctgcccaatctgaatgatagtttccgcgacaaatatgtgtattaatggttaaatcttctggtaagttagcaattgcaccattgttcaagtctaaatacagcgcctttagttgtttaacatcaaagccggatccagccattttttcccagaaatcagcatctactaacatgccccatgtacagtcatctaattgaactgttttagcacctgcttcatacaatgcaagaatctcttcatggtaaacacgcttaatatctgcaaaaaactcttcatcagaatcatagaagttcgatacaacatcagcatttgtaccacgaactagttctgcataaaattgagatggcgccggaattgtaattttggcttctacgcccacttcatcagcaagtgctttgagaaacttaaaatgcttaataaatgggtgtacattggcgtcaaagctcaatttaccatttaaacgtgctgaatcatcacgtgtttcctcatgagcgaagaagtagccttcgccgtagcttaatctttcaacgccaccaaatccccagaaattatccagatgccaatatgaacgacggaattcaccatctgttactactgctattccagcagccacttgttgatcaaccaaatgtgcaatcgttgaattttcaacaccttcaagttcttcttgtgtcaatttaccagcttcaaaatcttgccgtgcttgttttaattcagctggtcgtagaaatgaaccaacatgctgaaatcctagtgcctttagtgtctgtgttgtcataatttttccccttgtactttttgaattttagtagtggttacaaaacaacaaaaaagtcccgcagtctaattaatttagactgcgggacgactcgtcgtgttaccacccggtgtttatgtgtcgacaaaaagcctacacacctcaatatcaatcatctttatcatgcttcgagaacatctgtacatgatattgagaattgatgtcgctatatcgggctctcccggccattgcttgcgtcgtttcaacaaatgaatcagcgtgcgttcgcaataacagtaactccaagaccattttcatgtgttcgcgttgtctactttcaccaaatgtaaactctctttttaacgctacaacactacttatcttttctttgttaaaacaatcatactatattataataatttgtcaatacttttttcattaaacgttaaacaattttacgttcaaacgcatcactggaaataccttgtgccaagatgatttttgcccattccttagctgaatgtagactatgatctttatagttaccacaactttcgatttctgctgcgggcacttcggttacttcatcactaacaattttttccaatacttttttgaaaactttagctaatgtttccgaatcgtaatttacccatgagataacatgaaatccagtacggcatccaaatggtgacatatcaataatgccatcaatttcatcacgaacaaggcctgcaaataaatgttctagtgtatgcaatccacccgtttcaatcgatgtttcattaggttgtgttaaccgcaaatcataattagtaatgttgccgccattaggaccagcttgtgtttcaatcacacgcacatacggtgccttaacctttgtatgatccaaagtaaaactttcaacaactgtttctgacattatttttctccttcaagataagataatggcttaatgactttcgtctttgtgccatactacttcttagtgacatgctgttggaacgtttttgcgcggtacaacgttgccaacattttatctgtcttatgatctttattgttagccgcggttactattatattaacattttacaggtgtgattgttaacacatgtgttcattctcaagcaagttgctcatcagcaatatgtttgatcaacgctaattttttccattgatcaggaatcgttaagatatttccctcttccgttgaagaaaatccacattgtgttgatagagccaagttagacttaggcacatagtttgctgcctcgtcaattctggcaacgacttcatcaacatcttccaaatctgctgacttagaagttaacaatcctaatacaatttcaacattttgacgattattgtatatttctttcaaaggctcaaatccacccgaacgatcattatcatattctaagaaaaaggcatcgtagtttagttgacctagatactttgcaattggctcataaccgccttcaaacaaataagtcgacttaaagttaccacgacaaatgtgtgttgctaatttcaagtcctctggtaagccagccaatgccttattaattacataaacatcatcggctgctgttttttcaaactttgcacgctcctcgggattgtcagcatgaccgtttaactgcgctatcaagtatgcccaagttgtatcatcaatttgtacataacgcgcgcctagatcatagaacttctgcagtgtatcatgataagcttgagctaaatcgtctaaaaagtctgaccatgaatcataatattttgaccataaatcagaacggtgatcgcgattaataatcaaactcggcgatggaattgtttgttttggctccaccccttcaggcgtcactgacttcaaatattcaaaatccttaaagaatgggtggtctaaattagcatgaactttcccatttaaacgaacattagttgatcgcgttttttgaccgtgaaacttgtacgagtcattttgatcataaaattcaaatccacctagttgacctaaaaagtctaaatgccaccatgaacgattgaattccccatcagtgacagctgatagaccaaccttgacttgttcatcaactagatttttaatttcatcatgttgaacttttagtaaatcatcgtgcgaaatttcgccttgtgcgtattgctcacgcgcttttttcaggttttctggacgtaagtaagatcccacttgatcaaaatgataatttaatttttttgtttctgtagttgtcatgtttttctccttaaacaccggtattttaatacctacacgtaatctatcaagctaaattaaggctaatgcactatccaaatctgcaatcaaatcatctgcatcctctaatccaaccgagaagcgtaacaaaccaggagtaataccgcatttggccaactcatcaacgtttaactctgcgtggctcatttttggcgggtaactaataattgtttccactgctcctaaactaaccgaaaatactgggatatgtaaggactccactactttcttagcattttcttgactgcctacatcaaagctcaacaccgccccaccatttttagcttgtgaagcatgaatttcatagcctttatgtgtttttaaccctgggtataggacatttgatactttttcatgagcttctaaatgctcagctattttatgcgctgattcacttgaatgcgtcatacgaacaccaagtgtctttataccacgcaacaacagccacgtatcaaaaacgctaagtgttgccccgaccgcattttgaataaaataaacttggtctgctaattttttatcattaactacgacagcaccagcaagaatatcagaatgtcctgccaaaaactttgttgccgaatgaaccacaatatcaacacctagatccaaaggcttctgcaagaatggtgataaaaatgtgttatcagcaattgtaaacaactgatgtttctttgcgataccaactaccgcacgaatatcagtaatgttcaaaactgggtttgagggtgtttcaatatacaatgctttggtctctggtttgatagcctgctcgattgctgccaaatcgctaaagtcaacaaagtcgtgtgtgataccccagcgtggcaaaacatcttctaaaactcgaaatgtgccgccataaacatgtttactaacaacaatatgatccccagctgataaggtaaacagcacactactaattgctgccattccagtactaaaaaggtacccgtactttccatgttcaagctgcgctaatgctttttcacccgcgtcacgagtgggatttccagagcgagcgtagtcatattctccaaattcatcaaaagatttttgactaaaggttgaacttagttgaatcggtgtattaattgcacctgacagtggatcatttgttgttgctgcatcaataatatttgtccaatcactcatcgctttgctccttcaactgcttgccttaaatctgccaataggtcctctttatcttctaatccggcactcacacgcaccaattgattggtaatacccaagtgatcacgctgctcttgactcatatcgtgatgtgtttgcaccgcaggaatcgtaattagcgtttctggaccacccaagctttccgcaaaagacccgatttgtaatcctttcaaaaaagcatctacatcataatcgtttgacaaataaaaactcaacattccaccaacaccagcatataagactttatctataccgggcatacacggtaattttttggctaaatattgaccattttcattgtggcgttgcatccgaagatgcaacgttttcaagctacgtaacaataaccaagagctaaacgaatctaaaacctgtccgcgtgtcgtcagtgatatttctaatttttcagctaaatcatcactattaacaattactgctccagccaaaatatcattatgtccaccaagatactttgtggcggaatgaacgacaatatccgcgccaagtgtcaatggctgttgaaaaataggtgttaagaaagtgttatcaacagcaattaaaatatcaggattgatgtcttttacttttgcacttaacttctgaatatcgattactttcatcgttggattagatggtgtttccaaccaaacaagtcgcgtggtttcgttaattaaggtcgaaatgtcatccaccccattccaaacatcatagctcacgccactctgttcaacaatggcatcgaaatagcgatatgtgccgccatatagatcatccgaggtaacaaaatggtcaccatttttaatcaatgacgcaaacaaaagatcaatcgctgccataccagagctggtagcaaatgcctgcacgccctgttccaaatccgctaactgctcttccaatatttgacgtgtgggtgtttgtaaacgtgcatagtcaaagccagatgattcacccaaattgggatgtcgataggccgttgaaaaatacaatggactaactactgcccctgttttaatgtcatcactgccgttaccgccctgtgctaataatgtatcaattttaatgctcataagtatttacatcgcgaggtccctagacccagcttgttcctctcttgatttaatgttggtattgttgatcttgatgaagtcatcttttccatcaacagttccccccaatttacaaaaaatttttcagcataagtctgccatgtattggttggtttattattataaaaatagttcttaggcttaattgtgtttgggtcaattgctatatcacgaagatattcgttctctaaagtctcagtgtcgtattcgaaatgtccagtaatgtaggttgagtttacatgttcatccctcaaaatgaatgcgcccaaaatatcgtcaccagcaactttcaagcgtctagccacaccaaaatttggtatcgtaaagtaacgagattgtggcatactaatgttttccaaatcttttaataatgaatgacgtttaaaaatttggctagcttgaaagacacccgaaattttttctgacaaggctttaacaggaaagtttctctctgcatagccagcgccatacgctgcccaacatgcaaatagactttcagttacatgtgtttttcgccattctagtaaatgacgaaattcatcccaatagtcgatttgttcaaatttcatgcgatccactggcgcacctgtaacgatcatgccatcgaattttttgtgccaaatatcgttgagtgtgacatagttagtcataattgcatccgtatcgtggcgaatttcatgctcacttggtactgcaaatgttactcgcacattgataggcaaatgactcaacaatcttgtgaactgcttttcagtctgtaatcgattgggcattaagttgaccaagagtatattgatagtcggttctaatacttcaaaacgaccgattacaaagctttcacgcttcaacaaaccgttatttaatataacactcatacgttccctccaaattcttaaaaaataaaaaacgtcccgtagtatctaaagatactacgggacgttaattgacgtgttaccacccggtatttatgtaaacattgccagtttacacctccaaacgtacgccaaaaaatttcgtcgagaacatctgtgaaagctttggtttatacgttgtccagtaacggggacgcccgatttcaacttaccgcgtaacacatatgagtgttcgcttgctcgtatccgtaaaaaactccaagaccattttccaactaattatcttacccgctttcaccaaacacgagctctctagctaagattcaaagatgtacttatcttttcaacgtttatattgattattactataacttttaatttgatatatgtcaatagtttttaatatttctcatggtatttttttatatcttctttcatctcggttttatattcagcattagaaactactttatggtacaattctactagaatttagtgaggtaaataaattatgtacgaaccaacacataactcaaatgaagctgttgaggaacatataaacaagcccggtcgtcatgtcatgtttctttctgcagattggtgtggtgattgtaaagccataaagccttttattcaaactatcaaagatgaagttacacaaactgctgaatggtttgatgctgatagagacgaaaatattgatgtcgcaacaaaacataacatgcgtggtattccatcttttgttttgtttgaaaatggacaagaaatttcacgtatcggacacggcgaacgcctaacaccaaaagaaatcgtagattggtatcattcaacactttagttttaatgccaaaaatagcccataaatatcgcaagaaattactaaacttgtgatattatgggctatttctatgttgcgttaatatgctagttactacttttcggtattcttaataaatgtctgaacaatatctgctggaatagcaaatcccatgccttcaacactcgtaccgtccgtagaagaagctatttttgacgagttaataccaactacttgaccttttaggttaatcaatggtccaccagaattaccaggattgatagcggcatctgtctgaatagcagtagttgctgaagaacccgtttcttcagcagaaagtgtgcggcgtggggctgaaacaataccactagtcaaagaagtagcataatcagaacccaaaggagagccgattgctaagacctgttgaccagactgcagttttttggcattatcaaaggatgctgatgttttgatatctgtggtttttgcctttaacagagccaaatctttgcttgaatctgtgccaacgatagttgcttggatttttttaccgctagcggtaattaattgtaattcatcagaatcagctaccacgtgattattggtaataatatacgcatagccaccagaaattttataaacaacacctgaaccctctgatgctgtttccaattcagaactactatcttgctgattttgctggaaatatgatgaccaactactgcttgacgatgttttctgtaaattctgaacggtaaccacagcgtttttcactttgttataagccgttgttgccgtatcactacttgtgtaagctgttttggcaatagttgttgtaccagctgagttgcttgtttttgttgtatttgtacgttgctggaaccaagaatctggttgcaatccagaatagacaacaaaacttgctaccaatgccgaaactatagcaacgataattaaagaatgctttttcataactcgccctttcatatgtgtacattattgcttttctgacaaaatccacaccctattatatccataataatgacataaagtaaattaaacattaaaggggtaaaatgactttaaaaacagtaccttgcggctgattatctgctactgttattttaccaccgtgagcatgaactacccattcagcaatcgataatccaagtccggtaccaccagtttgacgattaccagttttgtcttcacgatagaaacgatcgaagacatgttttttagcctcatcactaattcctcgaccgctatcagcaatggtgaggacaaactttttcttttcaatacctgctttcacagcaattgtcgcaccagcatctgagtacttcaatgcgttatcaagtaacaaaactagtaactgatgaattcgtttctgatctataaagatcgcttgatttacatcaacctcaagtgtcacagctttctcttcaaactctgccatttcttgatatggtgtaataatgttttctaagaattgcttgacatccgttgattctttttcaatggtggtcatattagaccctgtttttgctaacattaacatattatttgttaaagaatttaaccgtcgcacttcagaaagcgataaaataatagcatttgactgatcacgaaccgttgattccggttttgtcagcattgtctctagcttaccttgaataacggccataggtgtccgtaattcatgagccgcattattaacgaagtcttgttgttgttgccaggattttaatattggtttcatatttcgccgagcaattaaatatgatactatcactaacaaaataccaaaaagaccaaaggaccagaacaatactttcttaaaattattcaagttatccatggtgtctgtaacattaaccgttaccataccatggactgcaatttgattatagcccttagcagcatttttcttgaactgaaaaccaatgattcggtaataattaccataaaatttataggtattaggtttaaccgtcattgttgctttatcaaatttgatagcttgttgcagcgctttttgcaaagctgcttgacgtgtatcctccgtattgctatcaattatcaacttaccatttttgtcaaataaccatgtttctgttcgcgtgctggtattattatacaaaggttgtggcttcttgacatccttgtcagaagttgaaagtaaaccattactatcatacatcgaaagcgtctgattgattgcagaatccgcactgttaaagaccgttcgagtgtatgatacgaaaatgacactagctaaaattgaaaatataacaaaaaagctggcgagtaaccagataaatccacgtacttgctgctttttattgattgcgttcggcatcctctacctctagaataaaccctatattacgtagggtcttaattaaattattttgtccaacggcttctaattttcgacgtaagttattcaaataaatattaacaacgttgattgtcgtatctgaatcaataccccatacgcgatcaaaaatttgatcacgagtgacaataatatttttgttttgtgcaagataagttaagatatcaaattccttaccgaccaatttaaccggttgaccatgcacttgcacaccgcgattttctaggttaatcatcacatccccaaccgctagcgtattatcctcagaatagacccctgaacggcgcaaaagtgcctttacacgaacaagtaattcctctcgatgaaagggcttcgttaaataatcatcagcaccaacattgaaaccttctattttatcatccagtgaagtttttgctgttaaaatcaaaactggcgtttcaacatcatttgcgcgcaaatttttgatcaactctaagccagtttcgccaggtaacatgaggtcagaaataatcaggtcatatggtgcttcttgcgcctcaaattcaccatcaagtccatctgtaacagcattgatatctgcaaagtcctgcaaaaaaccaacaacattatctgctagattgacatcgtcttcgattaataatattttaattgcttttgacattttcatattcctgtttacctgttttattacatttattatacaaatcgtaggttaaaaataagttaaatatagtgacaactttacttcaatcccacactaatccgcaaagcatgtgccacaagttgcatttcatttgaagaagcatttatatgtgcaattttgtcacgtaagcggcgcttatctattgttcgcacttgctctgccaaaatgactgaatctcttttcataccgctcatatgttcaggtaataatacatgtgttggcaatttcggtttagaaatttgggacgttatcgcagcgacaatagttgtaggggaattggcatttcctacatcattttgaatgatcaaaacgggccgcaccccagcctgctcagagcctattccttgctttagatcggcgtaaaatacgtcaccacgcataactgcttgatgttcttctgtcataatattctcacttctatgtacgcgtcgtgagacgctttttaataaattctaggcaaccgagcaccaaaatttgttagtatttcatgcggaatcgtctgagcatattccgcaatctcttctaccgatatttgattctcaccttcaaggccaaccaaagttacagtttttccaacagggtatttctgctttaatgttatcacaatctggtccattgtgacacgtccaattacatgttcaatatgtccatcgaccaagaccttcataccactcatgcgacgcagatagccatctgcgtaacctataggcaaagtagctatccattgtggtttctctgccgtatatgttgcaccataacttactgactcgccagttgtcaattgatgtactgaccccaactttgatttcaattgtagggctggtttcaagggtaaggacatctttttttcaggggcaccaggattatacccataaagcacagaaccgacccggatcgtatccgtataaatttcatcatgatgccaaatcgcagaccctgaatttgctaaatgccagtactgtttaggaataccagctgattgtacccactgataaaaacgctggacttgttcatcataatagttttgattattatcatcagctgtggcaaaatgagtaaacacaccagccaattgaaacttttcagtaccttgaatcagatgatacatgtcttcaacagcacttgctgaatgagcacccattcgacccataccagtatcaacagctaattgaacatctagtttctgcccatctttgatgtaatttactgcctcatcaagccattcagttgttccaacagctggtgataaacgattttccaccataacttctgtttgggtaacatcttggacaccaagtagaaaaatatttatttctgcttggggataatatttacgcaggtcaacaccttcaccaatcgtcgctaccgcaaaatcatagacacccacctcaaataaagcccccacaacttgttttgcaccgtgtccgtaagcattggctttaaccacagcaatcaatctttgtgcgcccgcatgcctcataattaatttagcattggtctgaattgcctttaaatcaatatctagccatgtcggccgtaaacataatatatcattgtctgtcatgataatactcctcgtttaggaaacagctttatactcattttttccagcagtgtcaaacgttcaataacaacaaccgtattcacttgatcaccgctatgtgtgattgcaacataggtatgataggggaagtttttcactttcattacaggtcgaccatttggctcattcaaaatttcaatatcttgccactgaactttctcaccgattccatagccggtggcttttgaaaaagcctctttggcagagaaacgtccggcaatatattcgttttggtgcttaccttttcgctcggccgctgcagcacgttctgccggcgtcaaaatgagtgttataaaactcttctgacgctcgactatttctgcaactcgactgatcgcttctgtgtcatttccaattcctataatcatggttctattgtaacaaaaggtcaagtgttgacaaagtttttttgcctacacttaacccttttgacccctattatttaaagtttttaagatttttgtctgttggtatcaaattttgccattttttggatagataattatcattgatatgatatgttggttcttgataacctcgtgcaaaaaagggctttattttcgtatcagcagctacccatcctcgccatcccatatggatggtgtcctgcataaagtacttatgtccaccatcatgagaaaagtcagcaatttggttaaagccttgtgactttaactgtttttttactttatccacactctgataatatctttttgtactcagcccagtatactttgaccaccttttattaacaggctgaataatgaacaaaacgtcagtatgctcttttgcaaactcttgtaatacagcctgaaagtcggaatactcatcagactgtcggtaatcaaaatgactttgagagttttccagcttcttcaaacttggtttgactcgcattctgaaaaacgagttttttatgccaaatttattattaccagtttgcttcttcgcaactctcatcgcttcccgctctaacaacgatacattatcagttttgggtaacgactttagtgctggttcaacttgcttatcccaattattagatactgcaaaatttgagaatagttggtcttcgcgcaataacattctatttcgtaacattaacaagctctgatcagtttctgacaaaggctcattatttttaatctttgtaatgagacgagcataaaagctattgtcactaatttgtttttgttccaataatcgtttcgcaataaatcgatcagttgcactaattgtcttaatgtttcgtaaccagttaacggtctgcaacggtgagtaaaactgtggaaatgcccacttactatcacgtttggtaaaccactgttgcgaaataataaatactgcctgctttttatgcaaagccggtgtcatttcttgcatccccaagtaatgcgaaagagattctgttccagcctgaccaagcaaaaatggctgataattacgcttatactttgctgccaacaccgatggatgcattgtatccagacggaggagttcgcttgacccaaagaaaggcacataatttgtctttgaattactaaaggccgccattttgacgctttcgcctttaaaaacatttttagaaaatgacacagacgctttttgaatatctttatttgataaataatttaatgaaaatggtgccaaaaatagtgcagtaaccatgacgaatgccaagattactggaccaaatatccaccatagcccccgttttttcagcatttttttatccaatcaatgattcaactttagcaactaccttgtttggtgtgttccattcatcacgattaaattcagagacaggtgcttgaatattgaacttactttctaaatcaagcaataattctaccgttgccattgaatctagcaacccattctcaaaaaaatcatcgtccatttggtcagaaatgtcttcaccaataattgtgtttaagatttctactatttgttctttcaagtccattattttttccctcgatttctaatactatcatttatataatagctattattttctatttgttttctttacactaacgttggaaccagattttgtctaacaaaccactgaatagtaagaaactaatcattattacgttgaatgttatcacaatcgctaacgcattcgtaaatttattatgcggtacgtgatgctttttcttatagcgtaaccacatatcattgacaacaagaccaacaccatgaaacaagccataagcgatatagtaccatttcaatccgtgccaaaatcccataatcaacatattaatgatataagccacgtttgacgttgtgactcgacttttaaaccattttttcttcatcatcagaaacacaagtctcataaagacaaagtcacggaaccaaaatgataaagtcatatgccaacgattccaaaactcttttaagtttctggacaaaaatggtaaattaaagttcattggcacttcaattcccatcacatacccagttgctacagcgaacattgaatatccagcaaagtcaaaaaataaattcaaaccgtaaatatacatatacgctattatccaccacgaccatccgccttgagcatgtgcagaaataatcgccatacgctcaacatttggcattaataccgttcccaaagcatgagacacgatgaatttatacaaaaaaccaatgaaaaggtatttgacagctttgccaagcatttctagatacttatcgtgtgtcggtgctttctcaacatctttcacgaaacgacggtaccgatcaataggacctgacgaaattgttggcataaacagcatgaaccgcaagaaaagccaaggattaaattcttgaatcgaaccatcacgtatttccatcaccataccaactgaacggaatgtcaaatacgaaatacccataaatccgagtaaggttgtcacttgcaaccaattagcaactggcgcaaccttaattaatactaatggcaagatagctaaaatagttgtgacataaaacacccaagtttggttgtactttttacgatacaaagtataggcccaaacaagcagccattgccaaatcatgtagataattaatgcgataccttcatggtatttctcaccatcaaacatcaagaaaataaagacaagtgagaccagcacttcataccaagctatacgctttccaaagtatagaccaatggctagaggaagtagtgccaacaataaaataatgaagtactgcggatctgcatagggttgtagattaagcattgccattcacctcagcaatcaacccttttaaatcaattttaccatttggtgttaatggcattgactcgcgatatataaatcgactcggcatcatataaggcatcataacgtctttcatgccatctttaattgcatttgttaacaacataggtttagaaaagtcattttctttgggcaccacaatggccaacagctgcttaactttaccatcagcgtcataacgtggaacagcgactacttgttctatccattgactttgttgtaattgttgcgcaacttcttccaattcaattcggaacccatgtaatttgatttgaaaatcactacgtcctttataatgcaacaaaccattttcatcaactgttgctaaatcaccggttttatatgcctgttcaccgttaaatttcgtaaaagcgtcatttgttttttcagggttgttcaaataacctttggaaaccgaagggccagaaatcacaatttcgcctttttccccagaagaaacttcttggtcattgctatcttgaatactaattaacgtatctttctttacgtacccaattggcattttatcgtagttttcgatgattttcttggtaatgcgtatacttgaaacagcaactgtggcttctgtcggcccatacgtattgtatattttcacctttggaaagcgcgctagtaacttctctgctgtcgtacgtgttagtacttcgccacaaaacaaaaacaccttcaaatttggattgttcgcttgattaaattctggatccagaagggcaacatcagcaaatgatggcgtcgacacccatgtagttaaatctaactttggtaaagtggcaaataatagtttaaagtcctcagctactgatttgggtaatgctttcaaagtcccacccgtaacaattgtgggaacccaatccatcactgataaatcaaaagaatatggtggctgtgataacacattactgccttcttgccagtcaaatgtgtcgccgatcatccaattagtaaagcttagtaaattatgatgtgaaatttgaacgccctttggacgccctgttgtcccagaagtgaaaataatataaaaattatcattttcttgaacagaatgtgtcaattcataaggtacattcgtagaaaatatacgatccagatgttgtttatcaatcattaaaatatctgaaattgatgttggtaactcatcaatagctaagatcactgcaggcttagcaatttcaataatatctgtcaatctttcctctgatgaattaacatcaactggaatgtaggcatgccctgatttagcactgcctaagaaactggcaatcatttcaaattgctgcccaccatacaccataactggcgctttttccggcaaatttagttcatctaaagcatgagctaaactatcagatgcttttttcagttgctcataagtatgcttttcccccagttcatcatacgcaacttttttaggctgcgttgtcgcgatgagatcaacctgttttaacacattatcaatcatgtgtgctcccccatttaaaattcattgtaaagaaaatgtccttccccaacgccagaatagccgtataagtacaaaagtgataaaatgattaagaaataaaaaacagtacgcccaacaaaattaataactggatgttggaaaaaatgctttaacattcgcagtaacccccgtataaattgtctctttaaaagctatttattttaactttaaagtatcgtcaataatataatgaaccttattataacatacatatttcagaatgttaaatttatatatcaaagaatggaacgatagattactatgattaaaaaatgtttctcgcttattgttaaactagacaatattgtattaaaaaaccatgttttccaagcaatattctcagcaatgcgacaaacactccccgttctggcaatcgacgtttacttgcgtctgttgttcgtattatttttagcaccgaatgctttattccctgtcatttttaatatcaatttaaaaataacaggcctgcaaataattctttctattttggacgtcgttattctcatgatttttgccgctgccttgacaaataaatacctaatctaccgcggcataaaaaataacatattaccaatattaaccaattttttggccacctacctccttttcactgtcaatacacaggatttttcacataatgtttcacaatatttagtggtcaccgtattaactttgctcagtagtgaatcctattatcaataccaaagactctttcgtaaaaccctacaaccttattcggcaagatttttagtttggtccgcttttatccttggcctctattttttggttcaaccgtatgttcaacaaacgacgttacagttactaatcagtagtattttgtcatctaatttcttcacaacattcgttggtctcctactagtaggagcatgtgcaccagttctgtattggttaggcattgcattgcctaacgaactaacttccaatcaaacaacaattaacgctgtcgtcaaaaatttagatgttattttgaaaaatactcacgcgacattgccataccctgaaaatctctatagtgtgtatggtacgttttcattacttggtggcattggcaatacactagcaattagttttttgcttttatttatgtcatcaaaaagaaagcaaaatttaggactgttatccgtattccctagcttattcaataataatcaattgctttattttggattaccattattcttaagacctctaatgttggttcctatgattttgtctagcgtggcaggcaccttggttggctatgtagcaattgccacacatttaataaagccagcttccttagtgataccaaataatgctcctaatttattaactgcattcttaggaagcggtaaattatcttccttaattgtggtagcaatagtctttgggttgacggtattgatttacaagccatttatcgaacttgataacgctgaggtacaaaatgagaaataaactaatcatcttatccagtttcatattattaatagtaattggtatttttagtcatagttgggttgtccacactcgtaccacacaatcgaaaatacaaacatcacatatgtcaccaattattctaattccgggttcaagtgcttcagtcaatcgatttgatagtctattaactaagctcaacactaagagccagcgacacgatgttttaaaagtttgggtcactaaagatggtaaattggtatacagtggcaaaattcgatctagtgatgagcaaccatttattgtcgttggctttcaaaacaatgctgatggttacgacaatattaaaaagcaggctaagtggctaaatactgctcttattgatttacaagatcgttatcatttccataatttccaaggaattggccactcaaacggcgggctcatttggactagatatttagaaaattactacagttctgatagtttcaatatggcaactttaatgacgctaggtaccccctttaacttctctgagtcctcatcacaacgtcgcacagtcatgttaaaagactttattgaaaaaaataccaaattaccctctaatttggttatgtattcgatagctggtactgaagattatacagatgacggaatcgttccagttcaaagtgttttagccggaaagtatatttttcaaaaacatgtcaaatcctatactcaaattactgtttctggagatgatgcgcaacattcaagtctcccagaaaatacagaagttgtgaaattaatacaagaacatatacttaaggaaaacactaataataactttcgaaaaccacaataaaagcagcccatctgggctgcttttattttatagcaatctcttgtatgatcttttttaaacgatattgcatttgctcaaatcgtcttttttcactatcttcaatatcatatttaagtacccctatgatttgtaatagtgcttctttgaaagcaacggattcagccatatttatttttgaaagtgattcacgcaatgcaaaaatatgctctggattatatgtgtcagttcccacattaatagtcgttaaatcgtcatccatagccagcattttatagttaaattgcgctttttcagtgtagtgatgacgaactaaatcagtagccctatttgataacgccgtaataaaataagtcgaaaatttagcccgtggtcgattacaatcatacttttgtacacacttcatcaggatttctaatccctctgaataccaatcatcctgtttcattcgaccgctaatctttcgcgaatgcacatcaaatatagccgctttcaaatgtttaatcaatacattatacgcaaattcgtgccccctttgcgcagcgataactgctccaattaatctatctgtccccaattatatactcccgccatattagtagtttaatcaactacttataacggatttcgtgaattatatccttgataaatcaacaaactagcagcaacactagcattcaaactctgaacatgccccaccattggaatcgtgaccataccatcaacttttttctttaataatggcgaaatgcctctcccttcattaccaataatcaacgctaccgcgccatttgcatcccaacggcgataatcatcaccagccatgtctgttccaaaaacccaaacattacgcttcttaagctcttccactatatttactaagttcgtcactcgagcaacaggaacatgttcaatggctccagtagatgtcttagcaacggttgccgtcagttgaactgcccgacgttttggaataataataccgtgaactccagctgcatcagcagtacgcaaaatagaccctaagttgtgtggatcttcaatgccatctaaaatgacaaaaaatggtgcttcgccttttttttcagcctgttcaaataaatcatcaattgacgcgtactcaaaggccgccacacttaaaacaacaccttgatgattaccaccatcggttagctcatctagttttgactttggtgcctgctgaataaccaacttcttcttcttagccaattgcgtaatttcgttacgaattttgtcttgtaatcctgtttgtagccaaaccttatttatttcttgcgtgctttttaacgattcaacactggcatgatgcccgtaaacgaattctgttggttctgttggtttcatttgtttgtactccctgtctccacctgttcaaaaatccatgtcattagttctaagatgcgctcatgttgttcagacatatacaaataaccaaataatgcttcaacccctgttgaaattcgatacgtaatgacatcggtattttttgcttttgtatgtgacttagcattacgtccacgtttgaagtaatctaattcatcatcggttaggatattgcttaccatcatttgctcaaataacgcagcatgcgctttcgcggaaacataatgtttactacgtttttgtagttcatttacttttgttaagcctaaagacaataagtgccgtcgtacttctagttcatagattgcatcgccaatataagccagcgataatccgttcatttgtctgtaatttaaattatgcataattcaattatacgcaattatattgacttgcgtacaaatttcaataaatgttctgcagaactatttaagtttacctatttttaatgaatatgagaagctctttggcataaacggtatcatttttggcataatatgcacatttgttttaaaaatactttttttataattaaaaaaaacacttatcatatatgataagtgttttttaatactatgcttttagttgtcaaatgtttttgcaacatcgtctaacttaggaatatctgaagcttcttcgctttcagactcaggttgagcgataacatccccgacaactttactcttgatcttgcgatattcagccataccagttccggcaggaataatcttaccaataataacgttctctttcaaaccaacaagtggatcgtttttgccacgaatagcagcatctgtcaaaacacgtgttgtttcttggaaggatgcggcagataagaatgaatttgtctcaagcgcagccttagtaattcccaacagaactggacgagcagtcgctggtactaagccttcaaacaaagctggttcgttagcgcgcttgaaatcagcgatatccattaatgttcctggcaacaggtctgtttgacctggatccatgacacggattttacgtaacatttgacgaatcattacttcaatatgtttgtcagaaacttcaataccttgcaaacggtaaaccttttgaatttcagttagcatatatgattctgttgtcaaagtgtctgtaacagctaacaactctttaggatcaattggtccttcgttgatagcctcaccacgcttaatttcgtcaccttcaccaaaacgcatacgtgttgtcaaaggtaatgtataagttcttgtatcagtttcgccttcaattgtaactgactttgtgcggtctgcaggattttcttcaatcacagtaattgtacccgtaacttcagaaatttctgcacgtcccttaggaatacgcgcctcaacaatttcttgaacacgaggcaaaccttgcgtaatatcattaccaccggcaactccacccgtgtggaagttacgcattgtcaattgcgtacctggctcaccgattgattgtgcagcaacagttccaacggcttcaccaacttcaacttcttcaccagatgctaagtttcgaccatagtcaagcactgaaacaccatgttccgttgttgatgtaaagactgaacgaatagttacttctttaatgccagcattcacaatcttcttggcaacatcttcatcaatcatttcattacgtgaaacaatcttttcatctgtttcagggtcaaatacagacttcattgcataacgaccgagaatacgatcgtacaatggttcaaccacagatgtgccatccataattgcttgaacagcaacaccacgatctgaatcattgtcaaactcacgcacaataacatcttgagccacatcaactagtcgacgtgtcaagtaacctgagttagctgtcttcaaggccgtatctgacattcccttacgagctccgtgagtagaaataaacatttccatcactgtcaaaccttcacggaagttagctgtaactggcaattcaataatcttaccaccaggtccagccatcaatccacgcataccagccaattgaacgaagttcgaaatgttacctcgagccccagaatcttgcatcataaagatagggttcgttggttcaaacgattcaatcaacttgtcttgaataatatccttggcttttgtccaaatttcggttacacgttgataacgttccgaatcagttatcaaaccacgacggaactgctttgttactgtggcaacttgactatgagcgtcttcaagaatagcaggtttttcctctaattccaatacatccgtcattgacactgttaaaccagattcagtagacttgtcgtaacccaaatctttcatacgatccaacaataatgaagtttctgtcaccttataacgcttatatacttcagcgataatatctgacaagaagcccttcttgaaaggattaacgatcgatgtatcagccaaataatcatgtatattttcaccagcatcaataaagaaactatcatcaactcgcttaaagttatcttctgatggttcgttgatatatgggaaatctgaaggcaagatttcgttaaagaataacttacctaccgaagtgatcataatctttgaacgttgctcgtcagtaaatggcttttcgcttggaaatgaagaagtctgaatacctactcgtgtatgataatgaacaaccttgcttgcaaaagcaattcgtgcttcatcaacgctagagaagatcattccttcgccttcacgaccggcttcttcagtagtcaaatagtagtttccaataaccatatcctgtgatggcgcaacaattggctttccatctttaggtgccaaaatatgcccagcagcaagcattaacaaacgcgcttcagcttgtgcttcatcagataatggtacgtggatggccatctgatcaccatcgaaatcggcgttataggcttcagtaaccaatgggtgcaaacgcattgctttacctgaaactaacactggctcaaacgcttgaattccaagacggtgcaatgtaggtgctcggttcaaaagaacagggtgttccttgataacatcttccaagacatccatcacgtcgccgtcagctttatcaatcttgcgtttagcagacttgacattgccagccaacttacgtgttgttaattctttcatgataaatggacggaatagttcaatagccattggtacaggcaatcccatttggttcattttcaagaaaggtccaacatcaataaccgaacgaccagaataatcaacacgcttaccaagtaagttctgacggaaacgaccttgcttacccttcaacatgtgtgaaagtgatttcaatggacgattacctggaccagcaaccggacgaccacgacgaccattatcaatcaacgcatcaacagcttcttgtaacatacgcttttcattttgcacgataatgcctggcgcattcaaatcaagcaaacgcttcaaacgattgttacggttgataacacggcgatataaatcattcaaatcagacgtggcaaaacggccaccttccaattgaaccatcggacgcaaatcaggaggaataactggaataacttccattaccatccattcaggtttgttatctgactggagaaaggcttcaataatgtccaaacgacgtaccgcacgtactcgtttttgtcctgttgcttcttgcaattcacgctttaattcatcagcttccgtagctaaatcaacgtttgcaagtaattctttgattgcttctgcgcccatgccagccttaaagccagcaccatattcttttttcagttgacggtactcacgttccgtcatcatttgcttcttttcaacaggtgcatcacctggttcaataacaacataagaagcaaaatatataatttcttcaagtgaacgtggagacatgtctaaaacaagtcccatacgtgaaggaattcccttgaaataccaaatatgtgtaacaggagcagctaattcgatgtgacccatacgttcacgacgaacttttgatgatgttacttcaacaccacagcggtcacaaacaatacccttatatcggattcgcttgtacttaccacaggcacattcataatcttttgtaggtccgaaaatacgttcatcgaacaaaccgtctttttctggcttaagtgttcgatagttaatcgtttctggcttctttacttcaccataagaccatgaacgaatcttatcaggggaagccaaagcgatttgcatactttcgaatttattaacatcgattgccatctatttgctgttacctttctaaattatttttcctcaaatgtttgactttgttcttcaaccttagagaaggctgcagcaacttcttcatcatctttgtttaacagatcaggatttgtacgggctagcttttcaagtgcatcaacaggcaaaattgaatcatcttcatccatttgacgcaactcaacttcatcacctgcaccatctagtacttgcatgtccaagccaagtgcctgcaattctttaaccaaaacacggaaagactctggtacaccaggacgaggaattggttcacccttaataattgattcatacactttaacacggcctgcaacatcatctgacttatacgtcaagatttcttgcaatgtgtaagctgcaccataagcttccaaagcccaaacttccatttcaccgaaacgctgtccaccaaactgagctttaccacccaaaggctgttgtgtaacaagtgagtaaggaccaattgaacgtgcatgaattttatcgtcaaccatgtgcgctagtttcatataatgcatgacaccaacaccaacacgcttgtcaaaagcttcaccagtgcgaccatcatagacaactgacttaccgtcttgtggtaacccagcctcacgtaaggccatttcaatttcatcatcactggcaccatcaaagacaggtgaagcaacatgaataccaagtttcttggcagcaaatcccaagtgcaattcaagtacttgcccaatattcatacgtgatggcacacccatgggtgacaatagaatgtcaataggtgttccatcaggcatatatggcatatcttcttctggcacaacaacagagacagttcccttgtttccatgacgaccagccatcttatcaccgacttgaattttacgcttttgtgcaatataaacacgaaccatcatgttgacacctggtgctaattcatcaccattttcaggtgtataaatacgaacgttttgaacgacaccgccgccaccatgaggaacacgtaatgatgtatcacgtacttcacgcgctttttcgccaaaaatggcatgcaataaacgttcttcagcagaaagttcagtaacacccttaggtgttaccttaccaactaagatatcaccatcgtgcacttcagcaccgacacgaataataccgtccgcatccaaatcctttaactgatcttcaccagtgttaggaatttcacgagtcatttcttccggtccgagttttgtgtctcgcgcttctgaatcgtattcttcgatgtgaattgaagtataaacatcttcacggaccaaacgttcatttaagacaatggcatcttcgaagttatatccttgccaagtcatgaaagcaattaagggattttgccccaaggccaattcaccttgttccattgaaggaccatctgccaaaacctcgtcggcttcaatatgctcaccgacatgtacaattggcttttggttatagtttttaccaccgtttgaacgacggaatttcatcaattcataagtatccaattgaccatcttcacgacgaactcggatttggcgaccgtccacatactcaacttcaccagatgcgcgtgcaatcatcgcaacaccagaatcatgagctgctttatactcaattcctgttcctactaatggtgaatgtggatcaagcaaaggcactgcctgacgttgcatattggcacccatcaaagcacggttggaatcatcgttttccaagaacggaatagcagctgttccaacagaaacaacctgctttggcgaaacgtccatgtagtcaatacgatcaattggtgtttcaatgttttcttcaccaaaacgagccataactgtgttgtggacaaagctaccatcttcatttaatggtgagttagcttgagcaacaatatagttatcttcttcatcggctgtcaaataatcaatcttatctgtaaccttatgagttgtccaatcaacacgacggtatggtgtttcaacgaaaccatatttgttaatgcgaccataagtggccaacgagttaatcaacccaatgttaggaccttctggtgtttcaatcggatcaatacgaccgtaatgtgtatagtgaacatctcgaacttcaacgccggcacgatcacgagtcaaaccacccggtccaagagctgacaaacgacgtttgtggttcatttcacccaatgggttagtttgatccataaactgcgacaattgtgaagaaccaaagaattctttgacagcggctacaacaggacgtatattgattaactgttgtggtgtaaccgtgttggcatcttgaattgacatgcgttcacgaacaacacgttccatacgcgttaagccaatacggaattggttttgcaacaattcaccaacagaacgaatacgacggttacccaagtggtcaatatcatcaacatgaccaacaccttcttgcaagttcaagaagtagttcatacctgccaagatatcagctggacgtactgtacgatcatcttcatcaatgtgcccattgccaatcaacaataatgtcttttctgggttttcgggagattcgattttgattttttgaagggttacaggttcttcaagaacagcatcacctgatggagtatatgttgttgtcttaaagtcttcacgatccaaatatggtgttaatttagaaataacttccttatcaactaacgtacctttttcagcaataatttcaccagaatcagggtcagccaatgtttctgctagtgtttggtttaacaaacgtgtcttaagtgacagctttttattaatcttataacggcccacagaagctaaatcatagcgctttggatcaaagaaacgagcaactaatagtgcacgtgatgaatcagctgtctttggttcacctggacgcaaacgttcgtatacatccttcaatgcttcttcaacacgagaatctgacatatccttatggacatctttttcaagagtcatgttcaatgcatcatattgatctgaaaaaatatcaataatgtctgaatccgaaccaaatccaagtgcacgtactaattcagtcattagcaacttacgcgtgcgatcaatgcggacgttagcaatgcccttggcatcagtttcatactccaaccatgcgccacggttaggaataacagtcgttccaaaatgcggacgtccgtttttatcagttgtctgattataataaataccgggtgaacgaacaagctgtgaaacaataacacgctctgctccattaataatgaacgttccttgctctgtcattaatggaaaatcaccaaagaatacatcttgcgacttaatttcaccagtttcgtggttcgttaaacgcaatgtaacgtgtagtggtgcagaatagtttgcatcatgttcacgtgcttcgtcaatattatattttggttccattaattgataatcaacgtattccaaagataaagtaccttggaaatcatcgattggcatgatgtcgccaaacatttccttaataccatcgttcaaaaaccattgatatgatgccgtttgaatttcaatcaaattcggcacatcaagtacttctttgatgctagcatatgaacgacgagtacggtgcttaccgtattttactaaatgtcctaccacatttatcacctcatttgttttttactgtgttttgatattacaatatgattacaaaacaagatattccaccaattttgcttgccaataggcacaaaaaaagcaatcgccgctgtttccgcagtgaacgtttgcctcaatataaagggattgcggacaatatttcgcaaaattccgaatttattcacagtactacaatagtcaattatacagaaaattaaaaaaaaagcaaccacccggttactttgtgtatgccgccggtgggagtcgaacccacacggtgttgccaccactggattttgagtccagcgcgtctgccaattccgccacagcggcataatataaagccctaaagcttatagggcggtagaaggggatcgaaccctcgcatgctggatccacaaaccagtgtgttaaccacttcaccactaccgccatggcagggatagagggaatcgaacccccatcaacggttttggagaccgctattctaccgtttaactatatccctataaccttaagctcagtcattagactgaaataacatggtgaggaattgcaccccacattacactggcttgtacatgtttgtcagtagtacttttatagcggtcacagcggggctcgaacccgcgatctcctgcgtgacaggcaggcgtcctaaccagctagaccatgcgactgtaaaacctttgtattgttttcttcatatagaaaaaactaagaaataattactgtaaattactgaaagaaaataaatttcacaagaggaaacaagcaatttaataatattaaaagcttatttgtcaacttatttgacaagtatataagtgaattaaaaaaattttgcaacctttgtgaaatcgtggtaatctaatatcaacggcttaacgcttacattattttcatgcaaacgcgcgcagtgttaaaatgattgaaggaacgcgatatgcatgttttaaaatctgatttcaagtttgcacctacatagctactttgctattgttagagttgctaaatagaatttgagattgggaaaatggaagaaaaattatttaataaaggctttttaacaattactattattaactttatcgtgtacttagtgtattatctgatgatggttataattgctgttgttgcacacaatcaactacatgcttcgtttgggcaagcgggattggcctctgggatttatatcataggaacgttaatagctcggctaatagttggaaaagagttagaactaatcggacggaaaaagattgttcgatggggcgctattctatatttaattacaacaattgcttacttatttgtaccaacactcgctatattagatgcggtacgtctctttaatggttttgcgtacggaatgacttcaacagccctaaatgctattgtgaccgaatttattcctgagaaacgcaaaggagagggtataaattattatgggttgagtacaagcttagctgcggctattggccccttcattggtttattgttattgaatgcaactagttttcgatttatcgtgatattatcggttatcttaattggaatttcaatggttgcattgtttgcaattaaaattaacaatgtgacgctttcaccagaacatttatccgaattgaagtcttggaaggtttctagtttcattgaatttaaagtattattaattgctggtgtaggatttttgatgggcttgtcttattcgtcagtactatcatttttggcttcatatgcggaaactttgaacttggtttcaattagttcattctttttcgtagtctatgccggtattgtaacattgacaaggccaatgtcaggacgtatttttgatcgctttggtgaaaattacgttatgtatccgagctactttttcttagctcttggtttagttgttttggcattgactcataatggatttactttgttattgtccggcgcattcattggtttaggatatggaacattcatgtcaaatggtcaagcggtttccttaaagttagtttcgagtcatcgtgttggtattgctttatcaacatacttcatcggcttggacttggggttaggtgtcggaccatacgctcttggtgctttacacgccgtgttgacattccgtgaactgtatttggtttcagctgttattcccttgatttcagcaatactttatctggtattttatcatccagatcgcatcaaaaaaaatgtagcaaccattcctagcgaggaattagcttaaaaataaaagcggtatgtttcacgtgaaacataccgcttttattttttaaattgtccaattgtctaaagtttcaacttcatgggttggcttttgaaccatctgagaaatttgcttaggtgtagaaacgcctgaatatacgagtaatgtgtcaatttgtgaattaatgccggcaagaatgtcagtattgtaattatcaccaaccataacaacatcttgttgattaatatgaagcttgtttaacgcaccatccataatgggtatttctggtttagctatcacagttggctcaacctgtgttgcagtttggatggcagaaattaatgaaccagctccaggtaacatgccacgttcattgggtaaattagtatcacgatttgttgcaataaactgtgcaccttgttggattgctaatgtagcggtagtgagcttttcatagttgaatgctcgatctagtccggcaacaacaaaatcagcattttcgtcactagttattgtaaaatcagcatttattaatgcatcccgtagaccagattcgcctattatatatactctttttttgtcaggtgaagcaatcgttttaagaaaatcggctgttgccattgagctagtataaacttggtcggccgatgtttcaatatcatggtttttggttaagttatcagccacgtcttctgggtttttggttgaattattggttacaaataggtaaggaatattagctgcctttagtcgatcaatgaaacgttttccagaaggcatctttttgttaccttgatatattgtgccatctaggtcgatgaagtaagctttatattttgacatgtttaatctccatttaatattgaatgtctatattatacccatcaacattggttgatatcaaacaacgaatcaacggacttctctcccatctcaatctccctaaaataaaatctcctaaaatattttataaatatagttcgcccgcaagtaattgcgggttttcgttggttataggttaaatctttatcctaatttgatatagaaagggtaaaatagaataacaggggaataaattatgcctaaaaaatatcgaacaccaccatttttaacaccatcagctattgtttccttaattgttgctatcagtgctgcaaatttagcagtaaacgttgcaactggtacaagtgaaggtgggaaagtatcatcaagtgctagtagtgccatgagcacttcgatgataacaagtagcacaacaagtaaatcgactagtagtgatgataaatcaagtagttcatcaacgtcgagcagcgatgacgagtcaagttcaacatcggatgatacatcagctgaggatacgtcatcgactgctacaacttcggccgcagatacgacaacctcaagtgctgctacatcatcatctggtacatcatcttcagcaacatcgtcaagtgataataatgcaacatcaagttcatcaaatgcaacacgtacaacaagtagttcggaggatacccaataatgctgacagttcttgatttaattaatcattatctcggatattttacgacaaattcaaaaaccaagggtcgcatatatactgttgttggggccggtggtgtttggtatctactttatttagcctatcgtttttttgtgaatggtcgttggttgcgtggtgcattaattgctgcagtattcttactattactttacttcgtcattttgaatataatatattattttacgaagcatacgagtaagtgggatgtttcacctaggattgagaaattattagggggacctcatgaggaaaagagtgaacgtgaatcggagacggttatcatgccggctaatggactatacagtcgacagaatgttatgtcaggcacagtggtaagtgacgcgcagcaacaagccaatttagacacgcttgcattagagatgcggcaacttgatctaatagcaaataattacgggcatcttggtgaacaagcgcaacgacaaattattgcgcaacaaggagtaatttacgccaaccatcctgggactttgttaccttattttgcaatgcgtgaaaataatggtacgctacaaatattcggcggcattaaccaattacaagctcgagaattgggtaatgtttctatggttggtctaacacctacggctcaagcattgactaattatcgcttggcaatagcttcagtagttcttataggagggccaagtcatttagcgacacggagtgagttagttgatgacgtgcagccctacaaaataaaaatagaaatagcgtatgatcatatataataatactatcgcataaaaaaagagctaataattgattatagctcttttttcatatgtatatgttgtattccagcttcaaagaaagtcgctccaatcgctgcaaagccgagtgattcataaaatccccgggcctgaacttgagcaccaaggacaagattttgaataccataagatggtgctagggtttcaatgtattccataagttttctacctaacccctgtccacgaagaggaaataatgtagcgacacgttgtatgtgccaagtatcatctgattctgctaatacacgagcagtggctgcaagtttgttatcaacataaataacgatatggatagcattctcttcagcagcttgatcattcaattcatctttaatgtcaaccccttgctcaacaataaaaactgctttacgtattgctagggcatcttcgtggataggtccgaggccttgttcatgtttaatctgtattttcatagcattattatagcaagttaagtgcaagaaaagcaatggggataacagtgagacgctggttcagtagaaattataaacctaaaccttgcaaagttggtataatgatagttatgaaaaaatatttaaaaaatatttggcatgaaactttggcgccaaaaaattggattaaacagctgaatactcgtacaggtttttttacgtggacggttgtattatttacgttaaaaacaattttggcatatggtgctgatttttattggttacatgtctccgaccctttgcagatattcttgatgctagtcaatccaatcgggtttacgataattatctttagtattgcgttatttattaagcctaagcaattatactatggtgcattgattttacttgatgccgcaatgaccggcctactatatttaaatgtgatttattttcgtgagttttctgattttatgtcagttaacacaatgttgggatacagttcggttaatcagggtggaaaagcagctggagcaattgcgtttgggattcatgatgtatttttctggattgatattatcatcctgattggcttattcttagcgcgaaagattcattttgatagtcgtccaatgatgcggttacaaccatttaaaattttaaccatcggtgtatttatttttatggccaatctattgttggctgacttgaatcgcccacaattactggttcggcagttcgatcgagagtacatggttaaataccttggtataggaccgtttacaatttatgatgccatcaatacatatcaaactagtcaaatccgaaaaacggctacgccatcagaattgacagctgtgcaaaactacattaagaaaaactatgctgcgattaatcctaaattttacggaaaagctaagggaaagaatgtaatcgtcattcatctggaaagctttcaacaaatgtcgattgatcgaaaaataaacgggcaggaagtcacaccatttttgaatagtctttaccacagtaagtcaaccattgcttttgataattttttcaatcaagttgggcagggaaaaacgtcagatgcagaaaatatgttagaaacgtctacatttggtttgccccaggggtctttatttactaaattgggtgatgatcagactttccaagcgatgccagcaattttgaatcaacgggccggctattccagtgcagtattccatggtaatatgggttcattctggaatcgtagtacagtttataaacgaatgggttatcaaaattgggtttcaggtgattatttcgatattactggaaaaaaggcaacttcttggggtctgaaggataagttgttatttcataattcagtcccttatttggaacggctacaacaaccattctatgctaaatatttaacagtaactaatcacacaccgtttactctagataaacaagatcaagaccctaatttccaaacgagcaatactggatcaaaattagttgataattatttcattactaatcattatcttgatcaatctgtgaaagaattttttgcttatctgaaaaaatcgggcttatataaaaatacagctgttgttttgtacggtgatcactatggtatttcaaacacagatgcctcttatttagcttcactattaggaaaagactctgacgactggactgatctagataatgcaaaccttcagcgcgtaccatttattgttcatattcctggaatgaaaaacggttatgttgaccatacttatggtggtgaaattgatgtggccccaacgatagaacatttattgggcattagtacgaaacgttacattcaattcgggcaggatttattgagtaaaaatcataagcaaattgtcgtatttcgaaataaagactggataacgccagaatatgccagtctatcgggaagaatatggaatactaagacagggcaagagattacaactccaggtaaggcattgcaggccaaggttgataaaattcaagcatatgtgaataaaaagttatccatgtcagataacttaaatcaaaaaaacttacttaaattctatacacctgaaggcttcaagaccgtcaaggccaatagttttgactacagtaaagaagcaaccattaaacgactgaagaaacaaaataaaaaattgggaacaaaatcaacaagtttgtttgctcaaaatggtaataagtcgacattgagtgattatattactgatgcaccggaagttgatgatgaaacgacagatacaaccagattattgccacgaaatgcggatgattggagtaacgacgaataattttttagaaatcaacctgtcgtgatgacgggaatataaatttggagtaatatatggcaaaaattttaattgcgctcgaaaatattgaactcgggggaatgaagcgagcaacaactgtcgtcggtaatgcattggcagcaagccatgaagttacctattatagtttttctgatttaccaccgttttatggattgtcagcacctttagttgttgcttcacccgcgctacgtctaacaagtgaagcgcatccatttaaaagatacgcccaagctattgaaaatttctcacttttagcacagcgctatgatgtggttattttagcaggtggactactatccagttttgcagctgttttgaaaccaaagttgccacatacaaaactgcttgggtggatgcataacaacattacgacttatagagatcaatactatgcaatgatgcgcgaggaatttatagctggcttacgtgttttagatgcggtagtggtactaactgattttgatttaggtggctttaaaaaatacaatgaacgtacggttaaaatttggaaccctttgacaattgcacctaaaggcccttctaaattggagaaacacattatatcgtttacggcacgtatcgctattcaacacaaaggaattgattttgctgtacaattggccactaaattaccggatgattggcaattagcaattgccgggggtgggatgcaggaggatatggaaacctttgagcaattaatcaatgagtacggggcgcatgaaaaaataatatatcgtggtccattgaaagataatgaattgcgtgaccattatcgtaactcaagtttatttctgcaaacatcacgctgggaaggattaccgcttgtcctagttgaggcaatgagttttggtttgccaattatcgctatgagacagacagggtccgcagaagtattaaatgagggtgaatttggggttttgatagagaacggtgacattgatggggcagctatagcgattcaacggctaatcaacagtcgtcagcagcaacttgatttagcagaaaagtccttaaatcgtgttcgtgattttcaaatcgaacccattttgaaacaatgggaagctttattttaattattatatagatatttgttgacaagtaacttgacaactatataatattaacttagaggtctaattcatggacaagcgcagccccattcataaaaaaacagcattcgataagttacaattcggcattggtgatcttgcgcggatgacaggcgtgtctacccgacaactgcgttattgggaaaaacaaggttacgttaaggcactggatcgtaatgacgatcaagaatcccgcttatatggctttcgtgcattcttaaaggttagcattattaagcaacacattgatgatggcgataccttgcgtacagcagtgattcatgctaatgaacacattgacagtgcaatgattacaaagcatattatgaaacaagcatttcagggcctagaagactttcaaggtactgtggcagtaaatatgggttactttgatgacgacgagacacaattgctatacgtatttttagaggatggtaaagccaagtatcgcgttgtcgatagtaaaaaatgattgtcaaacagacagtcattttttattatgtatactcacatttctgtgttgggcaactgaatgaaaatagagaattagatatatgaaaaagtggcagtataattttataataacatcccagaattctggccaaactgttaaggaactattgataaaatggtacgtgccacaaagaattcgcggcgctttgcgaattaaaaagcattttagtgtgaacaatattattgtacctactaactatgaattacaaacaggggatcagttgcagcttaatttcgatgcagatgactttcgtactagtgaatcaaattatctacccaaccatcagaagtcggtaaatatcatttttgaaaataaagacttggttgttattgataaacctgcaggaatgaaaatgcatccgcattcgccaacggaaactgatactttgttgaactatttagcaggtgagtttattcagcgaaaggtcagtgatcagccttatatggttcacaggatagatcgagcaacttcaggtttagtaattgtagcaaagaaccccgtcgtggtaccaattctagatagaatgttagcagataaacggattgtacgaacttatgtaacgtgggttagtggcgtcgtgcaagataatcatggtacaatcgcaaaaccgataggaatcgacgctcgagatgatcgaaaacgtgccgttgacgggaaagaagcccaagtggcgatgacacattggtggcgaatgcatacggtgttttgcagttcattactacgggtgcaattaagtacggggcgcatgcatcagatacgcgtgcacttagctagtataggacaccctattgttggggatgaactatacggtggagtatacaatggccgtatgctgctacattcagcaaccataaaaataccattgccgtttgatgagggagtaagaatgattacaggaccactcccaagcgattttccaagacagctacgataagcaacacaaaaagacgaacacttgaatgagtgttcgtctttttatctgacatcattatttgactaagatgaaattatgcttttttagtttctttaacttctgttggtgtgcttgcaacttcttcctttttatcaaggaagttagcggcaaatgctgccaatgcaccaccaagtaagtcagcaactaggtaaacccatacatgagtaagtgctttaccttgaacaaaaattgctggggctaatgcacgtgctgggttgaatgcaccaccagtaattggtaatacaacaacaattaatacggccaaccagataccgataataaatggtgctggtacgttattcaacttagtaacaattgcgattaccaaaacgaacaagaatgttaatacaagttcaaatgcaaatgcataccaacctgaaccatcagagaagtttgtttgtccaagaccagctaaggatacgaattgttttacggtcattgattgaccagacaaagcagtagttacagttgatgatttcaggtaagctgttacaccgccatagacagcagcagaagcaacaatagcaccaagtaattgtgcaatcacatagccaataaatgtcacccatggtaaacgcttttgaatagccattgccaatgaaacggcagggttaaaatgtccacctgagatatgaccaaaggcatagatggcaacggctaatgaaagaccgaatgccaaaccgacagtgatggccgattgtgttgtagcagctgaataaacaacgctaccagttccaaagaacactagcataaatgttccaaggaattctgcgatatacttacgcatgaaatttctccttatatgtatgtaaaattaccaatatctactattatacactcttagattaactggttgttaaatattaaggaaaggtataactaatgctttaataataatgcattaattgcaacaatgattgtggacagtgacataattaatgcggcaatcattgggtttagcattataccagcaaatgccaacacaccggcagctaaaggaatagcaataatgttgtaactagctccccaccacaggttttgcacttgtttagtattgctacgcttagctagattaataaagtcaataatttttgataactgatcagctattaatatagcatcagcggaagcatgtgctacttccgttccaacaccgatggcaatacttaaattagcttgagctaaggctggggcatcattaataccatcaccaatcatcattgtcgtaccatgttgttgatactctgaaaccagattgattttgtcttgaggggatacttgtgaatggatatctgttatttttaactcgtcagcaatctgtttagcagccaattcgttgtcacctgtaatcataacaggtgtgatcccttggttcaataaggtgcgaataaaggcaggagctgattctttgagatggtccccctgtgctattgcagctataacgcgtccctcttccaataagtaagagattgagccttccgtttgtagtggcgtaaaagtaatatgattttgtttgagatattttgccgaagcaagtgtatataattgatcatctattttaccacgtacaccataaccggcaatgttttctacgtgtgatgcttgtatttttggcgcgtgttgttcttttgcgtagttaacaatggattgcgcaagtgggtgggtagattgctggtctaatgcgctcataattcctagtgctttactttgatcaaagtcatagacactaaagtgctgtacagtaaattttccagttgttaatgtaccagttttatccatcaaagcaaactttaaatgatttgctgccactagtgctttacgatttttgattaatatgccttcttgtgctgcaatcgcctttgttcgattgatgaccaaaggtactgctagacccaaagcatgggggcaggcaatgactaacacagttgcggcaatattaactgcaaaacctagtccgcgtagtggcgtccaaataagtagagaaccaatagcaaataatagagccacccaaaacaaccatgctgcgactttgtctgctagtgtttcagcgcgtgatttcttatcttgagaagatagtaaggtttcttttagctggccaataaatgaatcatccccaacagtcgttaatttgacatcgagcgtaccattaccattaatggtaccaccaaccacttgagaacctattttcttttcgactagtcgactttcaccagtcattaaagattcatcaacctggcttacaccttcgactacagtaccatcagcagggaaagattcaccagccaacacacgaacaatcatgtttgattttagtgtgtcaataggcatatccatcaacatatcattatgtttgacatgagcaatgtttggcattaattcgcgtaacttagccgtcgcatctccggcttgcatggtcacagacatctcaattcggtgacctagaagcataataacatttagtgttgcaaattcccaaaagaaatccataacgtgaacatgaaatagttgcgtcgatagaaccgcgtaaatagaataccaaaaagtaacattcagcccgacggtaattaagctcatcatagcgggctttttagtacgaaattcagcgcgcgcaccatcccaaaaaggtttggaaccaatgaagtagaggagggtagataatagcgcagatacccaagaactgccaggaaaagtaaaagtaaatggcaaatggatacccatgaagggtgtgataatgatgattggaagcattaagaaaaaagcccaccaaaaacggcgtttcatgtctgacatatccatactgtccatgccggcatgagaagtgtgttcatgactggacatctccatatgatcgtggttcatgcttgacatgtcatggtgctcatgtgatgtatctttatttgtcatattcatatgatcatggttcatagtcatttacaatcctcacagttttcgggtagacagttacaagcaatgctttccggggcatttttcactttttgtgctagtaacgcttgtagtttgacaatgtctgactgagataaggtcatgtcagcaagtacatccactaatgtgtggcctatacacatggcacacatatcgtcgattgtggcacgtagtgtttgggtcatcgtttcatgttcacctacagttggtgtgtataatcgattgcgtgtagcaccatctgtacgtaacaatcctttttttagtattcggttgatcaacgttttaaccgttgatggctgccaatctttctggttgtgcataatatgaatgatttgattggtggtagcttcacctaacgtccatatcacacgcattatttcccattcacttgttgttagtaatttattcatacttttagtctacaactgtaaactaaaaaacacaactattttgaatgctttataaataaaaatgattgacaagacaaagtgtactgtgtattatagtacacgtagtacagatatcatggggaacaatgaaacacacaaaggaacagttattgataggacaatttataaaaacctatcaaaatttaataaggaagtgcacagatggcgcaaattcaacgcagtcaaccattatatgagcagttaatgtggcgtattaaagcgcaaattgcgtctggtgtattgcatattggtgataaattaccatcagtccgagaaatggctttaattgagggattaaatccaaatacagtggcaaaggcttataaggctcttgaaacgcaaaatgtgattgaaacggtgactggtaaaggtacttttgttcgcgaaaacgagggtattgtagatgataaattattagcacaattacgtttaaaaatgaccgaaattgttattgaggccaaacgtgcatctattgatgccaagcagctacatagttggattgaagaattatatggagaaatatcatgagtttaattttagaaaatatttctaaaaagatacaccatcatgccattctaaataatgcaagctttgaactcaaagagggagaagttgttggtctagttgggcgtaatggtgcggggaaaacaactttatttagaacaatatctggggagatgcaagctgattttggtcgtattggtctagataataaagattatatgaaaacaattgcagttcacgaccaattattttatattgatatgccagacaattggctagcatattacacaccaaagcggattaaatcaattttatctgtcgcttatgtgaattttgattcagaatggtacgatgaacgtttgaatcaatttggactaaacaataataaacgtgttcaaaattactcaaaagggatgaaagcgttgttcacgattattgtcagcttcgctagccgtgcccaatatgttttattagatgaaccgcttgatggattagacgtattagttcgagatcaggtaaaacagttaattattgaccgtgttacaaaaaataatacgactgttctcattgcgtcacataatttggttgaacttgatactttagttgatcgtattctattgctaaaagatggtacaattgatcgcgcatttgcgattgaaaataataaaaacattaaaaagtatcaactggcttacgatggggatgtgatgccagaatttctaaggaacaatgggacgatcattgctcaggttggtcatattgtaaccattgtgtttgataattttgatgaagatattggtattaggttagctggatcggatttcaagttcatagaagaactacccattagcagtgaagacatattccgcgcgagctttgccaacgaagtatatgcttggcagcaagaattagggggtgaacaatgaaacaagcactacggctatatggcaggattaaatctaatcaaattatattaatagcgatccttggtgttctagtgacttgttttattgggggcgtgaatacatattatgggagagcaataacaaacataggaagtgacagcgagttgggaggcgtacttatgggtataatgctcatagcagcaggcgccgctacgtacgcagatcaaacaagacacttgaatacctggttgagtacgcaaagtgcctctagaaggcagttcttcatcagtaaggtggtgtggatgattattgcgccaattatattgggtgctgctattgacttatttatgtccattacaatacgctctgataatttgcacaaagtggcgagtaacaatttaaacgacggtgtggaattattttacgtggctagtgtggtggtgttggttagtacaattgttggaccaatatggcaaaaaatcgtaggtagtttttttgcattagttgtttgctcatcactatctgtgggtgtgaacacaatatctattgactttgggatgaaagaactagttcaaaacgctgagttcacaacgttagttacatttatcgtagcactgctcttactgggtgctagctactatattgtgggcattatcgggatagaaagtgaacacgacgcagtacgtgtaccggctttgcggtggccagtggttatatttgtgtttatctcaacactgttcttgccactaaatgagagtccactgacagcaagctcattcgtattaccagtagttttgagcgtaatcacattcatcttcgtatttaaaccaaaattatcttggcaaaaatagttgattcaataaaaaggggaaaaacatggcattattggaagtaaagaacgttaataaaaagtatggtaatagagcagcaatggacgacgtcagtttcaacgttgaagctggtcacattgttggattgattggtcccaatggcgctggtaaatcaacaaccatgcgtgctattactggtttaatgagctactcatctggacaaatcacgtttgatgggcaacctgtgacctttaataatcatagtgcgcttgataaaattggtaatttgattgaatatccagccatttatccgaacttaaccgcgctagaacacttgaagttgtatgcaatggacacaaaaaatcccgctgatttcaaagaattaatgcataaaacgcaaattgacggggacaattttggaaaacgcaaggcgaaaaacttttcattaggcatgaaacagcgccttggtattgctattgcgctcatccgaaatccaaaattagttattttggatgaaccaatgaacggacttgacccacaatctgttcacgacttgcgtgaattaattcgctcattggctgaagaaggggtggctttcttgatttcaagccatctattggatgaattgcaaaaactagttgatgatgttgtaatcattaatcacggtaaaattattcaaacggctaccatagaaactttctttattcatgaccaagcacgttggacatttgacactagtgataatgaattagctctacaaatagcacaagataaaaactggcaagctacaattgacaacagtcagttgcaaattagtggggcagaaaatttgcagcaagtgatcacagcactcaatgcggccaatatacaaattcaatcacttaatactgcaactggcaatctagaaaagtcactacttgatatgctagcggctgataatcagggggaataacgcatgttaacattaatgaagcaagaatattacaaagcattcaagcaaaatagattatacatttggttgattttgggatttatttttcccattgctatcattggtatctttaagtcaacaagaacagctggatcgattattaaccttggtcagtccttaatttatgttgaaatggcaggaatcattattactgctttgtctatctcccaagagttcggttttggtacaattcgtccattgctgtcacgtcgctttagtcgaggtgaagtgttcatcagtaagttgttattaaatattagtgtttacattggattgtttttatcagcttttattggcactgttttggctactgctatatttgcccctaaatatgatttctcacaaaagttaggatatatagggaacagttggcagggcatgatgatttcgattatggatgtagcacttcaaatgatatttgtggctgcattagtattgatggttactaatatggtcaagagctcaggagctgctattggacttggcgtagttatgattgttgctacaccaatcatctctgtcatttcgttaaaattaattgatttagcaccaatcttgaagtggaatccattcaatatttatttaggtattgctagtattggacaagttaaacctagtataatggcacaaataatggatatgtcacaaggagcaatgatatcagcatacttgatatatattgtgttgatgtacggtatcgcttatttaatctttagaaaacgcagcgtttaaaattagtaaataataaaaaacacgaactcacattacgttcgtgttttttatttaaaaatcggctgaggaagcatcagtatggaatccacccacgccagtgagtgaatctaatgattcaatttctgctgatgttagagcaaagtcgaatacatcggcatttgctttaatgtatgtttcatgtgttgattttggtaaaggtaaaaatcccttatccaaggaccaacgaattaatatttgcggtaccgatttattgtatttttcactcagactaacgacttgtggtaaatcaacgagctttcctgtacctagtggggaataggcttcgttaagcatgccatgatctttatcatagtcaactaattcttgttggttatcagaagggtttaaaaagttttgattaaccatgggtgctatggtttgtgttttagctagcgcttctagatgttcaatttggaaatttgacacgccaatggctgtcgtttttcctattttatattcgtcttccaaagcacgccaagtatccgcgtttgcatcaatccaggcatcctttccttgtttttgaagggcagcaggatttggccaatggattaaatataaatcaacgtaatctaagccaagcttgctaagggatgtgtcaagcgcttgtatagctctttcatatgtgtgcgcatcgttccaaagtttagtcgtcacaaacaattcatcacgtggaataccagaatcttttatggcacgaccgacagaatcttcattaccatatacagccgctgtatcgatgtggcgataacctgcttctagagcccaacgtacagactgataagcttctgtaccgtttgcactttgccaagttccaaacccaattatgggaatttcgatgccgttggttagcttatatgtatctacaagggacatgttatttacctccgtgagccttttattatacggtgttgttttgatagcaccagttaccatcagtataacatgtcagcctcactaattgatttttagtgcacggagaaaaataattattttaacactggtttaatgttagtgcagtacagtgattatattgacaataatacttaatttgtcaaattagcgaagccccctaaaaaagatacactcaatctattattattctctcaaattataattctcttctctcccccgtatctttggatgcgggggtttcgttttgagtgatgaaaaaatctagctgtttcaaagtaactaaaaaagcaccaaaaccttatcgattttgatgcttttttatactgctccacttggattcgaaccaaggacctgcgcattaacagtgcgttattctaccactgaactatggagcaattagctgaattaatcaactattaaagtatatcaacgctggcatatcttgtcaacagtttattgcgaaagtaactgcttaattttttgtagtgctgttgtgagctgtgattctgatattgtcagtggcggtaacaaacgaagcgtattgtgccccgcacccaaagtaacaattttttcatccaataagtcagcaacaacttgctttacaggtatatttaattcaataccggccatcataccaaggccacgtacttcaacaacgttccttaactctttgaaggctgccaattcctgccaaaaaagattaattttttctgaaatattaggcagaattaaagataattcgtctagcgttgcactagcagcactcatagccagtggattcccaccaaatgttgaaccatgtgcattatatgaaaatgaactggcaaattcgtttttagcaagcattgcacccacagggacaccgttagccaatgctttggcattcgtaaaaatatccggttgaaaatgataattttcaaatgcaaactttttccccgtgcgtcccatgccagtctgtacttcatcaatcatgattaaagactcattatcatgaactacttgaattagttctgtaacaaaatcttgatgcgcaggaatgacacctccttcgccttgaacaagctcaagcattacgccagcaacgtctttattaaggagttcttttaaactgttaatgtcattaaattctgcatactggaacccatctaacataggtaatccataatgaatgctatcttgtccagttgctgacatagcaccataagtacgaccatgaaaagagtttttgaaagtaatgattgttttccgcttagtcactaaacgggctaacttaattgccgcttcgttagcttccgctcctgaattagcaaaataagtggtataatcttcaccacctaattttgctgccacagtttcttgcaattcattttcgtataaattaggcaagtgccagatttctttagcttgagcaataagtgctaactcaacagcatcattatttgcgccaacattatagacaccaataccactggataggtcggtgtactcattgttcttaccgtcagtccaggtggcatttttagttttcttaaatgttagtggggcacgttgatagtttggaaatagcgtcatgtgatatacctcaaattgtgacaatagtaccgggatgggtgactgtatttgtaatatgaacagcgcgcacgccatgacgtgctgcaaataaggcactgtttacttttggaatcatgccaccggtaatcatctgttttttttgtaattcttccatcgttttggaagttaaattttgtaaaacgtttcccttaattttcacaccagaaacatctgttaatagatataattcgtcagcctttagatacttagccagagctgtcgctgcgtgatccgcattaacatttaaccactgaccactattagtaattgccatcggagcaataataggaatgagatttttttcccaaaggttatgaattaatttagtattcacttggtgaatgttgccaacgtatccgaatgtgtcttgatcaattgtgtgaccagttaacagttgatcacttgcagcatttaatccaattacagataggccgttgacacggcaagcttcaagtagcgcaggttgtacctgaccaaggagtgccatttttgtgatgttgataccattttgtgttgtaaaacgaataccgtttatcttctgaacaggttcattaagttgtgacattaaggcagaaatagtgtcaccaccgccatgaacaattgcaattttataatgttgtttttgccaaaatttgatagtatcaaaaaaggcaggtgtaagttgagtggcggcgttgccaccaattttgatgactatttttttcattagactttatctcccataaaacgaacaagatgagaatgaattctcacgttgtataaagtgcattaatttttacatattcgtatgttaaatctgaaccccaagcacaaccggattcagtaccggcatgtaaatcgacatcaatgtgaatgtcatgctcctcaagtttttctgccatggtatcggcatcaaaatctgcaggggcaccatttactaatacagcgattttattaatgctaatatcaataagatttgggttaagatcgacattgctggctccaatagcagcgataatgcggccccaattaggatctttaccaaaaatagctgtttttactaatgaagaaccgacaatttttttagcaaccattcgcgcatcaagagcactttgcgcatgatttacagcaacagcaattaatttagtggcgccttcaccatcattagcaatagcaatcgaaagggcggtagttacggtgtgtaacatgtctttgaattgctcatattcagctgtatgattctcaatcattttatgaccagctaaaccgtttgccattactaagacagtgtcattagttgatgtgtcaccatcgattgtaatttgattaaaacttgtctcaacatcttctgaaagtgcttgctgtaaaagtttagcatcaatgttaatatcggtcgttataaatccaagcatggtagccatattcggatgcaacatgcccgaaccttttgccacaccgctcattgtgacaattttgccctgaatagtggattgaatggtaattgatttttccttagtatcagtagtcataatggcgtgcgcaaacccgtttgtgtcaccatcaatctttaactttttgatgccgttgataatcttatcgattggcagtactttgccaataataccggtagaagcgacgccaaccaggctggtatcgatgtttagttgttgtgcagtaaactcttgcatagattccgcatgtgacacaccaatgctaccggtgacagcattagcatttccagaattaacaataatggcttgcaattgaccatttcgaatcgtttttttatccagttgaactggagcggcctgcacttgattcgttgtaaaaacgccggctacactagctatcacgtcactgtaaatccaaccgagatcttttgatttgtgcttgagaccaacgtgttggccatccgcatgaaatcctatgggagcagcaatgtcagctattgatagtgttgtaatttgatttaataattctgtcataaggattttcctaagtatatttttagacgttagtatagtgaatattatgcgtattgagcaatcaaatgaagtcctgtgctttcctctagatcaaacatatgattcatgttttggatagcttgtccagcagcgcctttgatcatattgtcaagaacactaacaatggtgaggtatttggtatcaggattgtatgttagtccgatatcagtaaagttagtaccgataacctgtttgatgcttggtaattgatttttgggcatgacacgtacaaattgcttatttgcatacgttgcagtgtataattcctgaattttttcggcctggctgtcgtcgtttatcttgacataagcactgacaaaaatgccgcgattaattggtagtagggatgtggtgaattgaatatgagcaatatcggattgccattgttgcagttgctgggtaatttcaggaatgtgttgatgatggttggccttatacatggtgaagttttcattaacgttaacaaaatgactcgctaacgtcagggatttgccagcaccagataatccgcttttagcatcaatgatgatgttatctttatcaagcagatggttttgtgcaagaggggcaagagcaagaagtgtgcccgtggcataacaaccaggattggcaatgtaggttactttattgtcataaaaatctgctaagctgtagtgtgcttgttgaatcgcttcgtcagaggttggttcgtttttgtaccattttttataaatatcagcgggaagacgaaaatcaccagatagatcaatgacgggaaacttagcttgaataaagtcctgagctaaatctttggaaacgccgctggatgttgcaaaaaatacaagatccgcttcttgcataatatgcattgggtcgaatgtcgtaggcgttaaattatacattgattttagatgcggaaactgttcgctaatgtcagtgttttctgtttgggtattatgtatggacacaaccttagcattagggtgattgtaaagcagtcgcaataattcaagaccgccgtatcctgtaatgccaacgatagcaatttttataattttgtctgtcatggtgtgccctccttgtgtttgatgttttaaatattaaaccaataagcatttaaatacaataaatatgcaaaacggaattggatattttaaatttaatgtataaaaaaacacttcatacgaagtgttaagctcgtgcaggtaattcaagaattgctatatcaagtacgtgttccatgcttttggaacgtaattcattgaggaaaaatccgttctgcaggtcaaatttagtatctaaggcgaatacagttagtgtgtagttatgagtcttatcaggaggcattgggccaatataagattgatttatgctagcattggctgggtgtcctaacttttgcacatcatgccaagttgaatttgtaccaaatgtaccgcgtttggtagcacgaagattttcaggaatattagttacagggaggtttgccgctaaccagtgaatccaagggaaaccgcatacaggaacggcatcgtagtcgattaaactgacagacaatgattgggtaccagccggcgtgttggatatttcgactgggaaattagtggttggcatatcattggtacgataattagcaggtgcatattttgcatacttatctggtataaaaccgttatcaagtgtgacatctattttcatgatcattctcctattaagttttttttggcctgtgccaaacgtgtgcgaacagcgatgggcatttcagaattatatttacgaatggatgaaatggcatcaataacaatctttgtgcgggtatctatgtcttgtatgccagcagtttttgagtgtatttccttttcgaatcgttcaataaaatcaagctggagttgtgttttatcagcgcggagggtctcggctgcggcaacttcaccgttagactcaagggtagttatagctacattatacccctcaaaaaagtcagatgcattggtcgtatttttccaagtaatcggttcatttgctgcgtcaatatttttttctgtcgtttttttctttttgaaaatgttaaagaaagacataattagaaatcctttcaagtataaatatatagtaatttttcatgttcgtttaatggcgaacaaacgttttatctgatacaataaaaatagtttttggatcggggaaaattatggcagcacataaaacggtatttaatgacaaacaacgtatcttacggctttattcagcattgataagccatcgagcgctctcaattgaagaaattgaggacatgttttttattggccgaaaaactgtccaacgcgatatctccgaaatccgaacttttttgcatgatttgcaaatcggtgaaccaattaaatctgagattatttttgatcgtcattcaaagaaatatcgattgactgagatggaaaacttatttagagtcttcgataaaatcaataaaattgatgaagaggaatgacgcggttttggtgtggacggttatttattgtttgttagttggtcaaaatcgtctaccatatctttaggacccactaccgagacaatgtctttctcatgtagtttgtaggttgaatccggtgccacgataacatccccatcatggcgaacagcaataacatttaatccaaattttttacgaatattcaagttactaattgatcgaccataaaaggcggggtttacaatttgaacctctgccattgaatagtcatcagatagttcaatgaagtttaacatattaggcgcaagaagtttgcgtgccactcgttcgcccatttcgcgttcaggttgtacgacgacatctgcgcctatttttgtgagcacacgcagatgggtgcgattttcagccttagcaataacattcttagcaccaagatctttggcgttgatggtcgctagaatgctggcttgcatattatgaccaatggcaatcacaatatgatcaaaactagcaatgtctagtttgcgtaacacttcatcttcttgagcatctgcaatgacaacttgtgttgcgatatcacgataatcattaacatgttcttcactaatatcaatgcctaaaacatcttgcccattggcaaccaatgtttctaaaagggcgccgccaaaacgtccgaggcctataatggcataggtttgtctcatttttatttctcctaactatggttgcaaaacgctatccaatgataacggattcttctgggtatcggaagggtgctttatcatcatgtacatttagaatggagaacatgacggtatagattccgacacgaccaatgaacattgcaagcatgataataagttgtccaaaggttgttagatgtggggtcaggccaagagttaagccagttgtagcaaaagcactgaccacctcaaaaataatgtattctagcccataatgtgcagtgtgctcttgagtaagcattaatagaaatgataagatgcccaagaatgctagcgatacgaaaactaatagcagtgcacgaacaatgttttcgtgtgataagcgacgatgcgaaaatacaacatcctttttcccacgtaaagcagcgtgtgtttgtaaaatcaacacaccaagcgtagtggttttgataccaccagcagttgatcctggtgtaccaccaatatacattaacatcatggttaataacacggttgctgagctcattgaatcgaaaccaaattgtgcgaatcccgcggtacgatatgaaatagacataaataatgtatcgaaaatgcggtttataggttgaatgtcttgagcagagttcatattacgttcggtcaattcaaacaacaaccaaccacctacaattagaacacctgtcataacaagtgctagcttggagtgtaatgttaggcgatgtgttgtccgatatatgagcagatcacgccagactaagaacccgagagaaccagcaataattaggaaggcaataattagtagaatccagggttgattattataagcagctgtcccgtgaggtaaaattgagaaacctgaattaccaaatgctgaaatggcgtggaatacagcataaaacataccatgtttccaaccaaagtcatttataaagaaaggcgctagcaacactgcaccgatactttgaataataactgatagtttaataacatacccaaagaccacccgtgtatcatagaggctttccaagttatagacttcttgaaccatcattttacttcttaaatccattttttttcgggtggccgtaaataacagcactgaaaacgacatgaatcctagtgcgccaatctcaatcaaaaccatgatgacgatttgaccaaaggtggtccagtgggttgctgtgtcgacaactgtgaggccagtaactgaggctgctgaagttgctgtaaataagccatccatgaaggtgtgacccatattaccatgataactaaggggcagcattagcaatagcgcaccgactgtaatgactgttaaaaagcctaatgacaatcgttgtggcattgatatgcgtgaccaaaaagtatggcgttgcgatttgtcatgaaatttttgcatttcagctgcagttggtaaatcgatttttctagacatatttatttttgtagggttctttctcaaaatagattgttgtttaatagagaggtatattacctttgttcaattatacactgtgggttgtaaaatcggatatttttggatgatgagctgattaagattggctattttacagtatgatttcacgataatgatgacggtttacaaatgacgtcactaatgttaatataaaatgttcgaaaattatgataaagttgttagattattataattgtaacttatatttatcatttccagataaaaaataaacacgaatgccatgaattatttaaggggacatatcaagtatgattcgattaatgcaaaataaagatcagaggaataatattagtgtacgtattgctatttatttgacctatattgtacagggatttgctttaattattttagcgcagaccgtgcaacaattaagtgaattgtggaatgcctcaattgctggtacaactgctgtcgtttcagcaattggtattggaaagctaattgcttatccaattttgggagaattgtctgatcacgttgatagaaaaaaattattaatgatggcgatgctcatgtatttaatatttttttctattttaccattaacaaagaatatatttttcgccgttgtcataaccacgctagcaggactagccaacgcggcattagattctgtggcctaccccacattattagaaatgaatcatggtaaatccagtgggaatgtactgattaaagcaatgatttcattgggtgaggggatattaccgattattttagtcatgttgattaatcaacatatttggtttggttggttattttgggttgccacggctattctggtagtaaacttaattatcatgacctcaattaatgcagctggtttttacactattcgtacctcaaaagggggcaagagagctaccaataagggtacatggcattggaatattacaaaaatattatttatgatttatggattcagtgcaatgtgggtgatgattcattttactcagtgggtcacgcgatattttcacattgtacaatcattttcaacggttagttcgcatgtactaatgtctttttacagtattggctcactcatgggcgtgggtactttgtttttattgaccaaccggggatggatcagcgaaaagatattgttaatgatcacagcgataggaacaataattggattagttattgtcgttttgagccaagaaacaatcagtgctagtttcggttgctttatttttggtttttcagccgcaggaggagcgctacagttgggattgagtcaattaatagcctcagatccaaagttttcaggccgtttgaccggtctctattttttctttggtagtattgcattttttgttatgccaattgtcactggtcattttgccgcacaacacttgcaaggtgtgatgttgagtttgttggctgtggctggtttgaatttgtttattgtagtctttaatttttatcattcgcgacaagtgcagaaacagtaatttcataaacaaacacaaaaaagcaagactaacatgtcttgctttttttgtgtttgttataagttggacagatattttttcatccggttctgaaaatcaactagtggctctggttcaggttggctcatccagacagaaataaacgatgtgagcatttcaattaagtattctgtggttagaatgtcagcagccaatttaggattatatcgtgtaattagcgataaatatttggatttgataaatgtaatccaaatatttctaatgtatgggcgcgtatataaaaggtgtaattcttctttcttttcgtagagcatcggtgccatgtcgttgatgaaaactgatataagattatcattagttgacaagcttgtttctaccttgattttaacgtctttgtcaatccgattgattacagcataaaataaatcatcatatgagggataatattgtttaattttttggatagcgataccagaagttttttctagttgtttgagactaggcttatcttctctgtttgaatgcatattggctaagaaagatagtaaaattagctcttcatcattgtcttcacacggattagtcggtggaataataaaaaaatctagaggtaaatcaaacttttcaataattaagagcatcatttctgttgtagggtgccctttgtgacgttcccaattagagacagattgaaatgaaatatatagtttttcagcgaattgctgttgtgttagtccgttttttttacggagcgctttaattttattaccaatctccataatagtctccaaaataattctttgataccatgatataacatatttggaatgaatccaatattttatcataaaatgtctggataatcactaaaaaatgtcactttttaaactgctagttattgaaattcatataaagcggttttgttataattctacagaggaggggagcataatgatcgagaaccatgagttttgccgattgagtgaggcagatatagccacagttattgggggcgaatcagaagatattgcatataatctcagacgattgagattagaattagggtacagaagagcagatttagcagatgagttgaacatcagcttgtcaacaatagcaaaatatgagactggatcgagaataccggacattgatacaataattcaattatctaaagtattgcatacaaatgtaaataatttaatttttaaatgaaaagatattggacgggaaagctagttgtatggacaaaatgtctcaatttttaaggaacttattttatataatatgaatatattacgaaaggaggataactatttatggaaaagttgtcagaacaagaattagcaaaagtttcggggggatttccactattgccaattgtaggtccaattatcgctggtggagcaacttatgttgcaaaagatgcgtggaaccatttggatcaaattcggtcaggatggagaaaagcaggtaatagtaagtggtaaagaattatgtgtataacgcattaagcataatgattggtgtttttctagcacgtattgggttaaactttgtctcagaagaaagtttcttctacggatggtacgatgcaatgaagtttactggtgtaatatttttgttacaaattttatatttttattcaaggagaagtaaaaatggattttaaaacgcaacgtaatgtattgaactcggaaaagctaatgatgattagtggaggttcaacagatgattcttgggagggctttggctcaggactgcataaaacagtgaatacagttgtttatgctggaacaactgtggcaagagctcatactagaagtcatcaacgatgctttactggaaacaagtggtaattttgtctcaacgaaaaaaataagcttggtttttagataaatatcatagcaagttgagatcctaactataaacatgtttttgtgtttaaatttaagatatatcctgtcaaactagtaaatcttcatataattcttttgcaaaatcttgcgtggacatgattcaataatgttgactatgttttactggggatgtttgctggtatataatttgcattgatgtaggtagagtaatgttgatcatatgattgagtgaagtaaggattaaataaattttagaggttttggaaccaccatattttactaaattggtagggctgtatatactttatccattaaggctaagacaatacagaatatatgctagattacaagattttttcggtaatcttagtcgataagcatttaagaataaggttattcttcaaccttccaaaatataggcattcatcgtatatcatgtggaattttactttaatatttaacaatttgagtgtaaacgaacatagtattttaacactataaagggccacactaaagggaactattatgttatttatccgtggtggccttgtcattgacttaattttgtggattcatccaaaacatgcgcatatataaattagacgacaatatggtacacatgcccctactatctaaactgagtctgtagtactaacttaactaattattgaaagggtaatcaatgatatttaatcgtgcaataactgtcatatcgaaaaaggtaggacaacttattgaattagttttagtaacagtattaattgatattattttagacatatctccggcctgtgtatttatagataagtctaacgggtggttcgtgttattgtcaattatacttgggggtgttgtttcatattttggctatcgttacttagcatcaaagacaactgctatttttgaacgaattaatctgaaaaaaataggatttattattatcatgttggtcctgaccagagttctgatggattttataataccggctatatttggacaaaatcaagatattagtttaaatcaaacaatgattgaaagtatgtttcagcaaggtgggatggtagcattattatttaaactgaatactgttattattgcgccaataattgaagaaatttcctttcgtggcattatatttgaagaggcaaagcctttaggggaagttgtacagttcatttggccaacgtttgtttttgcggcagtccatgggccatcgacaccggagcaatggacggtttatttaactgctggcgcattgttgatggttgttcgcttagtgaccaaaaagttacaatattcagtaatgtttcatatggcacataacttgatggcaacggttggcttgtagaataaggaaaaataatcgtgataagtgggagtcaccttaatttgctctaatcaataggtaaaatgattgcaacatccgtgtttagagaacatggtataatattatttaaggaaaattccgcgaacagtttttgtccgcggaatttttacaacctatatagaaagaagtagagagtatatgaccgaatcaacaccagtcattgaaatgcgacatattatcaaaaaatttggtgattttgcggccaatgatgacattaacctacaagtccaacaaggtgaaattcacgcgttacttggtgaaaacggtgcaggaaaatcgacgttgatgaacattttgacaggattactgcagcccactagcggtgaaattctgattaatggcaaaaaagtatcagttgattcgccttcaaaatctgatgcattaggcatcggaatggtgcatcaacattttatgttaattgacgcctttactgtaacagaaaatattattctcggttcagaagtaacaaaaggattgtccttagacactaaaactgctgctaagaaaatacaagctttgtcagatcaatatggtttatcagttgatccaatggctaagatttctgatatatcagttggtcaacaacagcgtgtcgaaatattaaagaccctttatcgtggcgctgatattttgatttttgatgaaccaacagcagttttgacaccacaagaaatcgatgagttaattgtcatcatgcacaatttagcacaagaaggtaaatcaattatcttgattacgcataaacttgacgaaatacgtgctgctgctgatacggtgactgtcattcgttccggtaaatcaattgatactttcccagttgccggtgtgtcttctcaggaattagctgacttgatggttggtcgtgaagttagttttaaaactgaaaaagaagtagctcaacctggtgcagtgatattgtcgattgataacttagaagtgcaagatacacgtcgtgttgctgctgttaaaaacttttcgctagatgtgagagcaggtgaaattgttggtttagctggtatcgatgggaacggccaaacagaactaatccagggaattactggattaacaaaggtacaagcaggacatgttaagctaaaaggagaggatatcaccaataaaaagccgcgtcatattactgaagcgggtgttggtcatattcctgaagatagattgcgttttggtatggaagttgaaatgacattgtctgaaaacttgtcattgcaaacgtactataaacaacctatttcaaaatcaggtgtcttgcaacctgctgaaatggataaattagctgacaaattagttcaggaatttgatgtgcgagctgccagtattcatgtgaccgcgggttcaatgtcgggtggaaaccaacaaaaagctgtagttgcacgtgaattaaatcgtgataatgatctcgtgattgctgcccagccaactcgtgggttagatgttggagcggttgaatatattcatcaacgtttaatcgcacaacgcacagctggtaaggccgtattggtcgttagctttgagctagatgaaattcttaatttatcggatcgtattgctgttattaatgacggtaaaattgtcggaatagttgacgctcaagacacaaacaaacaagagcttggcttgttgatgacaggtatgagcttaacagaagctcgtgcggcattgaaagaagaggtggggtcctaatgattgcacaaaagaataacctttctgtggcaatgttttctgttttattcggtttaattgtcggcgcattgattatgctagtattcggctataacccaatttctggttatgttgcgctacttggttcggcatttggttcaatgcaggatattggtggtgtattgacgcaaatgacacctttaattttgacagcattagggtttgcagtggcttcggctgcaggattcttcaatattggtttatcaggtcaagctttagccggatgggttggggcagtttggtatgctttgagttttcctgatatgtcagctatcatcatgataccaagcgcgttaatcattggagctggtctgggtgccattgctgggttcattcctggctggctacgcgcacagtttggtgctagtgaagttattgtgacgattatgatgaattatattttcttatttttaggaaatgatatcttgcaaaatacgatgtctaagaatattaaggagtctgcagaaacaaccaaacaagttggtgccaatgcatcgctccagatgaaatggttgactgatttgacgcaaggttcaagcatttcagcgggaatatttattgctttagcaatgattgttgttgtttggtttgttatgaagaaaacaacgcttggttttgaaattcgtgcggttggtttaaaccctgatgcggctagatatgctggtatgtcagcaaagcgtaatgctacaatagctatggcaatatctggaggtttggcaggtttagcgggaaccattgagggacttggtaattatctgaacttctttacgcaaaatgggtcaccatcaattggctttgatggtatggctgttgctttacttggcggtgggtcttatcttggtatacttggtgctgctgcaattttctctatattaaaaatcggtggattaggaatgccaatgtcttctggtgtgccatttgagttggtggatatcgttacagcctcaattattttctttgttggtgtgcgctatttgattctattaattcaaaagcgaattaaagatatggacgaaaaagcggcgttagaggcagccaataaaaaagcggcaaaagcaaatcagcagaaaggcggtgaataaaatgtcactcatggcaatgttatcacttgttatatctagcacactagtttattcagcacctctgatattcacttcaattggtggcactttttccgaacgttcaggtgtcgttaacgtcggcctggaaggaattatgggaatgggcgcttttgcagcagtcgtctttaacctaacatttgctggacaacttggtgctgccacaccttggttaggcttgctagctggtgccattgttggggttgttttttcgctaattcacgctgttgctacagtcacactacgtgcggatcatattatttctggaacagtcattaacttgatggccccagctttgggtgtattcttaattaaagttttatatggtaaggggcaaacggagtccatcgggcgagactttggttatgccacggttcctggattatcaaaaatgccagtattagggcaattattctttgaaaaaacatctgggccagcttggttagcaattcttgttgctgggatatcatggtatattatctttaaaacaaagtttggtttacgtctgcgctcggttggtgagaatccacaagctgccgatacacttggcttaaatgttgcacgtttgcgttattctggtgtgatgatttctggattgcttggtggcattggtggtgcagttgtagcacagtcaatttcattaaactattcagctagcacaattgttggacaaggctttatggcgatggccgcaatgatttttggtcgttggaatccattaggtgctttgggtgcttcgttgttctttggtttgtcacaatcacttgctgtgattggggcacagttaccaggattgaaaaatgttccttcaatttggttacaaatagcaccatacgtactcacaatcattgtgcttgtgttcttctttggtaaaacacgtccgcctaaggctgatggtgtgaactatattaaagcagcttaaatcacataaaaaagcgaatcttttgattcgcttttttatttataagtaagctgctgttttctcagcaattgcattagctgatttttgtagtagtaccttttcttcatcggtaagttgtagatcaaattcagcagttacaccatcacggccaataatggctggcgtagaaatatatccttcaaaacgttcatcatagtgagaaacgatggcttctctgcgtgcattggatagaactaattttgcaagagaaacagcagcatgagcaatggcaaaattcgtatattttttaccggcaaaaacggtaaagcccccgacacgtgcagcctctgcaaccttatctagattaatatcgtacaacttaactaattcatctgcattttttcctaatgcattaacggtagaccaagcggcaaattgtgaatcgccgtgttctccaagcatataaccactaattccgcgaggatcaattgctaatgtatcacctaatgcacgttttaagcgtgcagtatctaggtaagttccagtgccaaaaacttgattcgctgggaggccagttgctttttgatagataccagtaataacgtcaacaggatttgagataacaatgagcacaccattaaagcctgcttgctttaagtcagatccaacctgttgtacctctggggtattagcttttagttctgtaaaacgatcgccaccaggcttaatcaattcgatgtgtcccagagcagaaataacaacttcagcgtctgctaaatctgttactgttccagcgtgtacttcgacatgatgatctaatagactggcagcatcacgaaaatcaagctcttcagatgcaagtttttctggatttttatccactaaaacaatttcatctgctaatccttgtgcaataatgatgtgggctaccgttacaccaacatgtccaatgccaacaacacctatttttctcatgtgagtacctcgttaatatattatgtgttacaaattagattatacacataattagtgtaaatgaaaacagcagtggtactgtctcagtgtcactgctgttttggtaggttaaaaattaactgacaaagtattttaaaatttgcgtctcatcaagtgcttttttttcgtcatcgcgcacatcaagtacaatattaccggcatttaaaataattaacctgttaccatatttcaacgcatcggctaaattgtgtgtaatcattagggcagtcagattatttgcagtaacttgctcatttgttgcaagcatcagctgctcagatgtcttgggatcaagtgcagcagtatgttcatctaacaaaagtagctctggtttaacacgtgtagccattagaaaacttagtgcttgacgctgaccaccggacaaatcaccggttgctgtattgagacgacggtctaaattgttgcccatgaccttggttaatgcagcatattcagtcaattttttttgtgttaatccacgacttcgtaatgtacgcttgctacctcgcttttcagcaagaagtagattttcagcgactgtcattctaggcgcagtacccattttaggatcttgaaagacacgagcaatgtaatttgtacgcttaacggctgtttcatgagcaatattattaccgttatgcaagatttcaccagatgctactgataggttacctgcaatagtgttaaatagtgttgacttaccagcaccgttagtgcccaaaaccgtgatgaaatctccgtcgtaaatatcgaaattaattgactttagtatttgaatactatccccaactgtgacaatgacgtctttaagagagaaaactggtttagtcatgtggtgtaacacctttcttaattattttatcgagattcagcgcatgacgcagttgcggcaaaatcatagcagcagctaagacgatagctgaaataaggttgatgtcgttagtagaaaaaccaagtcgtaggacagctaataagactaaacggtatagaatagaaccgacaataacggcaactaaacgctcatttaatgttaattcaccgaaaacaacttcgccgataataattgaagctaaagcaataacgataatgccaatacccatgttgatgtcagcataaccattattttgtgcgataacagcgcctccgaaggcgataagaccattggacaacattagtcccatgattgtcatgcggtccgtttgaatcccaattgattgtgccatgttagggttgtcaccggtagcaataaaggcttgtcctaattcggtttgcaagaaaaaaattaatcctgctgtgatgacagcaataataaccaatcctaagaaaacagagtcaaaatattttggtaagtgctgcaatattttgatagagaaaatcgacttttgatttagcaatgagatatttgctgaacccataatacggagattaatagataatgttgccgtcatgactaagataccagataaaagaataggaatttttcctttggtataaagtaacccagtaattaacccagcaattgtgccgactaagaaagcggcaatggtcgcgataaatgggtcaattccgtgagcaatcatcgctactgctgttgacgcacctaaagggaaagagccttcaacggtcatatcaggaaagtttaaaattcgaaatgtgagaaacaacgcgacaccgagcacggcccataagagaccttgcccaatactagatacaatcatactcatttgaagacttctcctttagtttcagcttccttaaccatgcttgctggcaaattgatacctagcagtttggcttgctttaagttgatggtcatttcgccctttgtaatggttttgacagggtaggttgcggtgttcttaccctttaagacttgtccggccatgacaccggcttgataacctatatcatactggctaacggatacagtggcgacgccaccatccttcaccatggtatccacggcagggataactggaattttttcttggttggtgacgttaatgagtgttttcatagcacttgcaacgccgttatcttgtggtgcatagacaacatcaacttggctggccattgtttcggcaacttgttgcatatcgttagttgttgaaatagtgtacattttaacagtgtagccagcttttttagccagtttttccatgtttttagcattatattcaccaccatgatctgatgttgtgtaaataatacctaatgttttagctttgggaacgacttgttgaaccacatctaaatgttgctgcaaaggagagtcaccagaaacaccggtcacattatttcccgggcgttgcgttgttttgactaatccagaccccgctgggtctgtaattccggctaggataaccggattattaccatcagctgttttggctaaggataaggcagctggtgtggcaatgccgattgttaaatcagcattctcattggcaaatttttgtgacattgttttgagatttgattggtcagcctgagcattttgatagtcaatcttaatctttttacctgagtaaccttgagattttagtcccgcaacaataccatgatgaatttgatctagggcagggtgcgtaactagttgtaaaatgccaacagttggcacgtaagttgattttttttcttgtgtgtttggtttgctagtaacaataaatgctacggctagaaatgcaacaataattgtaattgccgacaaaagtcgtttgttcatgatattctccaaatctctctgctcttctaaactaaaatgaccttggctcgccacgcagggctttccaaggtcaaaagaaaagtctgcatggcatattcccatacagacccgattgttgcaaaaaatagtcggtatggataaaacaaatgttttaaacatcagctttatccgttaccgaaaagctgattttaccgacgccaccaggcgttattgagttgaactgctaagttttgcataattatctccgagttgtttatgaaataagaatactaagaatttgatgagttgtcaatagttttttcaaaataaaaacgtatcagtatgtgtccttttaaaacagtgtagaatgcctaaaaagtttttctcataagaaaaactgaaagaataagcaatatttatggatataataaagataaaaatattatgtttattgtcaacgtaaacatattaactaaaagggagttatatgaatgatttagtcaatactttttcagaagtcaataatttaggtcggttaattcgtggcatgcgtgaagcacgtggcgtttctgtcaatgatttagtccgagcgacagggttgtcgcgtagtatgatttctaaatttgaaagagggcagacagacattcagttaagcagcatgattaagatatttagtgctatgtccttaaccttagatgacttatgtcatgcgagactatttgacgaatttttaatgaatgaattgtgcgaaaaagcttatcaatttcaaaatgaccacatcgtgttaaaacaaattttagatgaaatatgtagccgtgattttttaataagacaagaagaaattttaaaattaattttgcagacgttgctcaattctaatcgtggtttgccaagtgaagttgagaattattttgataacctagatggcatttggtctttcgatacttatttggcattattggcagaacctttcttaactcaacgtattcacttacgaattgctaaggaattagcccagtatcaaggatatcgtcccaaaattattaacaccgcgtatcatgtttttgttcattaggaggttgtgtttaggctccggcatcctacagaaaagatcactctaaggagaatgttgatgaaaaatatcgttataacgggtggtacttctggcgtgggatttgccattgccaaagaaatagcaaaagaaggacacaatataattattgttggtcgtcatgaatataaagcccatatagctcagaagaagctaggaaataatgttaaagtagctatcggagacctatccgacgaagctgaacgtgagggtgtgattgatgaaattaaaaggtcattttcacatattgacgtgctaattcatagtgcaggtgttctcccacgcaatgcgagtgaaaatatctatgtgaatttattaccacattattatttaacgactagattacgtggcttattagcaaacagtagggtgttgattatcacaggacacccacaagcagtaaatcttgtaccgatttgtgaaatacaaagtagcgcattttctagagcagcgtgggtaatcacgcacaaaacgctcctaatgatcttattaaatcaaatgttgcgagattgcaataccacagttaatagcttttaccccggacaagtgaatagcaatttgatgagatataccaaaaaaatagataacacagaagtaccggtaggagcatatttggcgcttaatgctactttagagaaaatgtcaggcatattttttgatgaaaatggtaaaatagtacagcttgataataagaagtataatttaaaaacagcagaagaaattttggcaccatacttgagtaagataactacgtattaggaactatcatattgtggattaatgaattggatgttattattctattgacttaaatagtaataattactataattaaaagtaattgttactatttattgaaaaggaaaaaataataatggcagaaaaaaatgatttaagcagtgcataccgacgattaaagagtccgaacgcgaagacaagagaccgtgctttgaaattattaaaagaaatcaaggctaaaaagtcacaaaaaagtaaatagctgttcaatatgtgaaaaggcatcgtatgttatgatgcttttttgattgggcgcatatttttaaccgtttagtgcatttttacaaccgtttatgttattgaagtagaaaaactaaaacaagtgtatatagttattgttatacagattaaaatacaacaaatttaaaagggagggtgaaaaacatcaaattacatcagaagagataatcatcaaaactatctgatgcgtttgtttatgttttgaaatttagattgatcttaatcgtgctaattattgtttataattggggaattgtatgaagtgattttgaaaaaagtcatttcaggtgataatgtgcatgcgccatagaactgttttttatggtgattcagtctacatacttgggacacttaatttgaatcataaagtgttcttgttattgaagtgagttaatggggagaaggatatgaaatggaatcgttatttattcaagttcattacctttgcatgtgtagttttatcttcaaaattaatggagatggacaattttcgaaaaagctagtatgttagatcacaattttacattgatcagcttcggaaaatttgttgcactataaaaaatttttggagtagtataggtccacaattgaaaaacacagcaagggggctgtgtttttcaattgtggtggtctgtgatgatgaagaacaattgatattggggctcatcatgtcacgcttgtgctcgtgtcctattccttcaaccatgcgtatgggaatcaaaaaaacgtaccaccttttttactcaagggtgatacgtttttttaggttgtgcacgctattgatgaatcaacgtgtttttaatgtgcgaaatccaagtgtttttccccgtgatgatactaactgttccagtttgtccataatgaatattttgatagtcttttggacgtaagtttaatattgcactgacctgataaaaattaccgtcttttgttgtaataggattagcaggaatacttgtaatattgcctggtatcaccatgtgtttgctatttttttctgttaaatgataacgtattgattgattctccactatctctgaaatttcatttgcagagatataaaaactaacttttaagtcaggagtttttttgagatttggatatatttgtgcaatattagttccttgaggaatgctagttaattttgttttgttgattaataaattgaccgtgccggattcagtagcgatgatagtatttttgccacttgtttctgttgcagcgtgttgtattttggtctgttcaatttcttgattaagcgtttctaattctttcgtaatagaggctagttgttgtgattttagttcgttgagcttgtttgtgagcgcatcttctgctaaatttgtggaagaaaaaccggcatattgtgtcttatagctagttaacgcgtcatttattgaatcaatttgttgttgaatactagttacagtttctttttttagtttatctacctgtgaaatgggcaactcttttgtttgatgttggtagtctaagaaggtgctgtagtaggcatttttaggtgataagcttgtgttttttattatggcattaatcaggtcttgatactggctaagctctgaatttttcttatttatagcttctgatataattattttttgctgtttgacgcgatcttggttattgacttgttgctgatggtctgtagacagactgcgacgttgagaaagataactttggtatgaagtggaacaaccaaagttatcgtcatcagtaaataaattttgattctgttttatgctgtctttatagattattagtgcttgtacatgttcttgcagatttttaagcgatgatttttgtaattgtaaattggtatctgattcagtattttgatactgaatcagaatatctccagcagtgatttccttttttgtaagtaattcgtttttaatgatgggattattacttgttgattgtatcgttctaagtattttgattggtgctatctctccagtgcttttaataacagtttctttatgagtaaggcaagcaagcaaaataagcaagaccaaaagaataagtgttggaaaaatgatgagtgttgtgaaattttgatatcttttagtatagaattctgagctttctaaaagcctctcgttgaacatagttgtacctcccattattaatgctttacaagatgatagtattttgattttttatgtataagttcagcatggctaccatcttcactgatgatccctttttcaagcagaataacgcgttggactttttcagcaatagtcaggcgatgtgcaataaaaatgattgttttatttttaagcgataataaattatcaataatctttttttcagttgcgacatcaagattactggttgattcatccaaaataagtatttgagaattactaaggagggctctagctaaagcgatacgctgcttttggcctccagacatgccgccttcctctgaaatttcggtttgataactttgtggcatattttcgatgtcatctttaatgtcagcaagctcaacagaatgtaggatgtcttcttgtgttgtgttttcacgagcacctagtgttaaattatctaatatgcttccagtaaatatgtatgggttttgtggtagataaagaatatgttgccttaaattttgtcgttgaacgtgtttaatgttttgttcaccaataaaaatgttgccagcactaggagatataaaatgaacaagtagtttggctaatgttgacttaccggaaccgctaacaccgaccagagcaattttttcaccaaaggggatcttaattgaaaagtggtgtaatatgttcttttgataaccatattgatagctgacgtcgtcaactataatgttatgagggttgttatgatgaagctcttgtgattctgattttttaaactctgattttacaagatagacttcgtttaatcgtcggttagcaaccgttgccgtttgtaatttcgcctgcaagttaataatattttggaaaggttcagtaaagtagcctagtaatgcattataggtaactaactgaccgacactaatttgattactaatcactagcttggcacccaaccataaaacgagcacattgataatgagttgagttgcttgtttaatactattttgaatggcttcgcttttttgatgggcaaaggatttttttaaataatcgacaaattcacgatcaattttttggtagctcgtcttctcgcttgtcaaagattttatggtttcaataccattgatgtcttcaataatagatgagctcagcgttgcattacttgccatctgttcttgattcaatcgttcaaatggcttcatgaaacaatagacaatcaagaagtagataggaaaagagattagagatagtagaaaaagttttgtattttgaattgctaagacgctcccaacaattatcgtgatacctaaatctaaaaaaagtgagagaattgtatttgccatggcatcaataatggtgttggcgtcattaaaacgcgttacaatttcacctgttcgacgtgtggcaaagaaattaacaggtagttcgaacaagtgccgtatgtatgatagtatgacttcaatcgataatcgttgtcccataatagttaacagataggtgcgagcaaaactaagtagctgttgtaacacataggtggcaatgagtcctaatgaaacaacggttaatgtgttagacatagcactaggaatataagcatcaatcactagttgcatataataagagccagcgatactaattaaagtgactagcaaagaagcgacgacaatattagcaattaatcctttttgtcgactaataattggcagaaaggataggatactgtttttattttctttaaaaggtttatatctgggtgaaggcgacatgaacaatgctacaccagtccactctttagagaattcttgtaacgtcattgcggttttagcaactgttggatctggatctgcaatgataactttgtttttagtgaatccgtacactacataataatgcaaatattgaccttttttctcaacatgagcgatgaacggcagaggtaaatctttcatgtcgaataaggtaaggtcagcttgaataggacggacatccatattgaatgattcagcggccttcactaatcctagcgccgttgtacccgataaggatgtttgacagcgttcacgaatgttagctaatgaaacatctgagccgtgtcgctttaaaatcatagctagtgctgctacgccacaatctttttcttcaagttgtgatatataatgaaactttctcatgcttatgcgctcctataaaatagctttaaaagtttattttatagtgagaatggcattttgttattaattgatcataattggttgttattttgtgttgaatggtggacttttaaccattcaacatttcaacatgaccgttcgttccatttatctataaaaacacagcaagttagtgtatatttaattctatcgttgcgcagcggttaaataccaaaataatagggggaagtatgatcaacagtacagcggttaaggaattaaatgacatggaattagaaagcattaatggtggttggtcaccacaaggttttgctatttcctttgtacttggaggggcagtgggtgttggtgcctattcaatatatcaattcggtatggaccaaggatatcgaaataataaaaaataggattatatttattaaggagggtaattacgtatggcattatttaaagaattaagcaacaaggaattggtaaatgtaaatgggggagtagtcccagtagctgtagttttgggtgtgccaacattagcacttggaatataccaggctggatatgcggcaggaaaagacagagctcaagctggcttacgtcgatgaaatatctactgttgcttttacagtgtctaatatttatcgctttatgtttattggtaatattaatagggttaagtgatcaacatcgttttggagctttatcatatcatgctataaataatatgtttgttttgttgatgcttctccagtttgtgttatttttaatacccaataaattattaggtgcattcgaaaacagtttgtccggatatttgaaaaaaaaatcattatggaaaattgttgtatggacaggaataagtggtggcatattgtcgttgaaggaaatagtttgtaacaaattttaaatttatggtagattgtaaaattaaaccgaacaattgtacgttaacaccaaatattgaggtcgttctcaatcaccacgaaaggtcctttagcaattcttcgtgttctattaattcttgcaatctaccatgtttataagtaggagggagaagattggtatgagtttgaaaaataatattgttggatttaataagttagatagtgaagagcttaaaaatattaatggtgggtgttatccgttgttaattattggtgcactggctggaattgctattagaaatagaatcaaaaaatagaaaaggataaaattatgcataaaaatgacctaattaatttttctaattttagtcaacttgatgaatatcaattggctagtgtcgatggtggatttattccggttgccgtttgggcattgtgggctggtgcgggtgctgcagggttcagtgggggaatcgcagttggattgaatagagtcaatagaaataactagaacaaatgtttgaagggtggttgtgacaatgcttaaagaattatatgagtatagatattggatattgtttttgtttgtgggatgtattggatttttttgtggaattgcagtaggtcttcaacacgttaattctatagtttaatgatcgaaagggttttaatatgactgaattaaataaaaaattgcaaaatagtttacacggttatgatattttggatgcacaacaattgtcagaagtggatggtggtattgcgccacttttgatagccggtggaattgttttggctggcggtggaggttttgctgcaggatatggtttatctagatggttaggctgatttaaaaaaatttaaattagcctaacgaactactcttatacaaaaaacggactagttttattcagtgcgaaaatagtatgggagtatttttttatgttaattcgttattaacaagattttaagagcttttgcaaaaagcactgttgcacgttttaaaacatatattttcttttagaatattatagttatagggacaaggtactttcttattgtgggaattagccggataaagtgcaatttaagatgatttaaatttacctgagtgcctattttattaagtaattttaaaaagttgaattctgaagaattactagagtcagaaggaatagctcctctgattgtggctggtttatggatcgctggagcagttggtggcgcctttgtgtggggatatgataaaggatatcaatttgggaaggatttggctaaataataattatgacagatgacacgagcgctgcaatagcattaggagcatttatattatattttgtcattgcagcactgcgtttttttacagatgtaggtatcttaaatattatttctgcaagagacttagagcaagcatctcattttttgctaataataacttttgttaatttgattgtatggccattaaaaaaagacagtaaattttctcttcttcggtaaatagtattatatcgttgtcttttattacataaaatactattttatataattcaattgtaaaaaaacaatcacattacttattcaaattagacagatggcaagaaagtatatggttattataggggaaaacatatcaaaagttctcaggttactgcattattgttagtgatgtactgttgggaaactattaattctagctattgcagatcatacacaaaaaaataaaaaagtcgggttcactaagatggtaacagtgaacccgacttttttagtcacaggaggtttcttaatgcttttatttttcttcgggaaattagacaagttagttgattatgaaggataatttcattattgactttatcaatttgttcaattttattaatatttacaagataggaacgatggctacggaataatcgatcatccatcgcttcgatatcttgtaatcgacctgtgaactggatacgtttatttttactcactaaagcgatttgtcgtgtaccagatattgtttcaaagaatagaatatcattgaagggtatctgaaaatggcattgtgaggtattgtagtgaaataagtctagaggcttatcttgatgctttttttctacaagatgagttaagcattcttttaattgctgcttaaaatcacttgatgattgcgttttatctataaagtccagtgcagaaatatgatattggaaagtaagtggcaagaattcagaatgagtcgtgacaaaaataatagcagcatatggatcatgttttctaatttctttagcgacctgaaacccttttttatccgatcctttgatttcaatatcgagaaagtatatgtgatgcgttccattactaagtaagtgctgtgataattgttctggctttgagtaagtgttaatctgttggcatgaccaattgttttcctggactaattcgtttaagtagcgtcgcaatttttgttgctgtatgatatcatcttctaaaatgttgatgtgcataaaatttatccttgtgtaatcaatgtctgtcggaatcgataattgctgtattcggtttctatgtgtgcttgttcataattacttaagatatgttgcatattgctcaatccaatgccacgattagctcctttactagttacgccatcttgaaaaatatggccgatattaataaattcttggttagtggaattttcaataatgagacggtgctcctgcttaatattatctgtaataaacgcaatattaataaacgccactgagcatgcttcgctggcttcaatagcgttgtctaataaaatacccagcatacgaatataatcaaaaacatcaacgtgacaagtggaccatttttgttcaatttcgaattctatatgaatacctttttctagtgctaaaataattttatttgatagaatacttttgattgcggggatgtcgatttttgttaatgatcctaaggtgtgattcccatgatttaatacattcggggagttttttaatacatcttcatatatagagcgaatctgattgatatcaccggcttgtatacttgtttctaaactgacaattaggttggcataatcatgacgaaaaccattgatacttttatagagatcttcgatttgtgttgtataggttgttaaatgatctaattgctgttgcttttgctgcgctaattgaaagttgaaataattttgggtagtattcttaagataaaccaataatgatattaaactaataacaaagaacatattaacagcatttttatatgaagtattgttaaattggtacgtcaataaataaagtattaggctaatagacaatagtgagttgataaatttcaaacgattgcttttctgtaaatgttggttttttcgtataatttctagattcggtgcaatcagtttgattacaccaaactgtataatgcctatgagtattggcgtagcaatgctgtcatagagagtcacaacatcgtctacaaaaaagtgcgaaggcaaaaatagttcgccaaatgattgaagtatggttcctaaagcagataccgttaaaatggcgtatagtccataaaaacagatgagatgaatattttgagtttgtctattgggaagtacccccaacaggactaagtacaatacttgtacagagtgccccagtatactcaatgagtgtgttgttactagaatcactattacaaataaaacaaaatagcgtaggctgtactttgttttactcatcgcacagaatataatatattttatgcctgataaaaatagaaaaccaaacataacgttaatcattactaatatatacataacaagttccccctaactctagttacattttacattaaaagataaacgtttaccattaaaatcagctcagtcaattaagtaaaccaaaaaccattaacgtaatgttgttgaccgttcaatgagacaatattgaagttttatagaatagtagagataatggttatacaaatataatttgagggggttaaaagtaatggaattagaacaattcaaaaaattaaatcaggaaacgttaactaaagttaatgggggagatttgctgcgtggtatgtgcaggataatgaacaacgcacattttttttgaactaagtagtaacttataaaaatatttagaaggccgctagtctttgaaaattagtggctttttataatacattaattagtatcaaaaattttctgtttgatatcacccagtaaactagtataatagcatttataattacaacttgacaaaatttaaatgggagaattatgaataaaatattatctatcggtgggtcagatacaagtggtggcggtggtatagaggcggacattagaactttcgaaaaatacaacatatttaatttggttgctattgaaaatattgtgactatggcaccacaaacatgggcagtgacacaatatacagtgccaaatcatctgtttgcgtctcaattacaaacagcagtggcggttgatctagctggcattaaagttggtatggtttcagatgttgataatttcaatacactggttggctatctagaaagcgtgaagcctagtgcattgttagtggatcccgtcatggctacaaaattgtcaatcgataatgatcgtacggttgatctagagacttataaagaaaagttattagccaaagcggacattattacgcccaatattttggaagcagcgatgttaacgggagtggagtctattaacaacgtgtccgaaatgaaagtagccgctgaaaagctatctagctacggcatcaaatatgttgtcattaaatcaggtagtaggtttgataataatctagctacagacatgctgtatgatggtactacttttgaaatattccaacgagaattgatagcaactgattacaatcatggtgcaggctgtactttttctgcagctatattggcgaacattgtgaaggggatgccgatacacgaggcggttcttgatgccaaaaattttacatttcagtcgatagaaaatgcagttagagtcaatcaatttgtaggccatgtttggcaaggagaaaatggtcatgagacaacaaaataggatagtcatagacattgtgttagttgctttatttactagtattacatttgtagcgaccagtatacaggttccaatgccggcactgataggaaaaccatttgtacatttgggcaactcagcagtgctcctttcagtactcttattaggctataaacggggtgcattggctggtggctttggattagcattattcgatgtgatgcatggttatgccatggaagcgccttattattttgttgagtgcttcattgttggtggtgttgcggcctatgtgttttcattagtaaactataaacaacatggaaccaatttaaaattaattcttgttattctttcagctgtttttgctaaattagtaatgacaacggggcataattttgtgatgagcttatttaaggggatgacactgcaaccggcaataatagctactatttcatctctttttcctactataattaattgcattacgacattagttgttgtctttgtgatatatcgagtactagctgaacagtttaaacgattatttgtaagaaataattttagttaaacttcgacttaacggtaaaagctattatcttattatttataggatagtagcttttttgctcataacagttgtgattaacgaacactattttttctgacggtggtttctgaattaactctaaaacgactgaagtatagtaagataaagatatattttattaagcatggtgattgccataaaatgaggggagcaaatatgggtaaatttaatttttcatgtaccaatattgataatttgaaaagttcatatgattttgtagttattgggtcgggcgcgacgggcatgactgctgccattcagtcgcaagaattagggctggatgtggttatatttgaaaagttaaatagcctagggggtaattcaatgcgcgcgtctactggtatgaatgctgttgaaacgatgacacaattaaagtatcagataattgactcgcaggaatcattttatgaagagacgcttaagggtggaaaaggtagtaataataaggaattattgtcatattttgtgagacatactgaatctgcaattgaatggttgtcttatcataatattgaattaaatgagattgtatcgacaggtggtatgtcaaaaaaacgcgctcatcaaccaaccggtgccactgcaattggcggttatcttgtaaaggggctgcaacagcagttagcggagaagcgcatccctgtctttaatcagacaaaagtcttatctttagttaagaatgatggtcatatctcgggggttgagattgagcacccgcaagcagggaaaaagattattaatgccaaaacagttctgattgctagtggtgggttcgcacagaatcgtgccatgatgtcagtatatgctcctgatttattaaggttaggcacgacaaatcaccccggtgcgaccggtgacggtattaagcttgcaacaactgccggtggtgcactggtagatatgaacaaagtacaagttcacccaactgcccagcaggaaacggatcatatttatttaataggcgagggattgcgcggtgctggtgctattttgatcaatcatttaggcaaacgctttactaatgaaatggctacacgtgatcaggtgactaaggccattaatgacctgcatcaggatggagcgacactggtatttgatcagggcatttgcgaggcatttaaagcagccgacttttatgttgccatggggttagctgtttcaggaaatacaatatatgagctagcggaaaaaataggtgtaaaccctaataacttggaaaaaacagtaagtagttggaacatgtatcaaaaggcctttgaggatatagcatttgatcgccagacaggcatggatcgtggtattgagaagtcgccttattatgcaattcacattaaaccggccgttcattacacaatgggcggaataaagactaatcgtttaactgaagttttaaatgagataggtgaggcagtaccaggattatttgctgctggtgaggtggctggtggattacatggagataatcgcattggtggtaattcaattgccgaaacaattgtttttggtcgacaggcgggccagcaagctgcaaaacatgttttgagtttgtcataaattaaatttttgagagaaacgtggaaagactattggtgaggcaatagtctttttagtatgcaactactagttgcgaccagcgcagctaaagggatacagagatattgcgcttttgatggtcaagtgaaatcttttacgtataataaaacctgtgcacaacaaagtgaagggaattaaaatatggaaaatatattcagttatcagctcaatatgttacgggaaaagaaaagtttatcgcaggagattattgctcaaaagttatatgtttcgcgtcaatccgtttcaaaatgggagcgtggggatgctgaaccagacattgataaacttattgcgttagcggacatctttggagttgatttaaattatttattggccggacaacagagcccagaagaattattattgaagttgacggccgttcgtaaaggctttaaaaaaccagtattaaatgatgtgaatttagaaatttatggtaaggatcgcattgcattattagggagcaatggttcgggtaagtctactattgtaaatattattgcgggcatgctacgaccagatgcaggtcacatcgaaagattatttgatcccaaagaggatttaaatgttatgccccaagaaaatactttaatagaaacgcttcgattggcagaacatatagctctttctgccggcattcatcgcatttattcaacgcaatttgttagtgggttattacaaaagtttcatttggaagaacaagctaatgtcagaattagtgatctatctggcggtcaaaaaagaagacttgcattattgttaagtgtaatgagttcttcaaagcttttgattctagatgaaccgacagttggcatggatttagaatctattgatttcttttggaattatatggatcatgttgctggtagtgttttgactattacacatgattttaatcaaattgatcggtattttaatcgtattttgttattaaaagacggcgtgattgtacaagatgaaaaagtgacggaaatacattctaataatcagacaattgaagaatggtaccgtaagtataataataacgaggggtgatacaggatgattacatatatagaattaaaggaaacgtttcgaaatagacgcttcattttatttacacttatttcaccagtaatgtggtacatattcatggttaatatagcaaagtctgccgggttctttactcatcgttattcgagtatttggtttgttgcttcttgcgtaatgggtattacaggcaactcggttgttacgtttggaaaaaccattaatcgtagtcaaaatttttactttttacaggctaaaacctcgcgttatggtataaaaaattgggtgttggatcaaatgatgattcagttgattttaaatgtcctcattgcgttaactgtaaccatttgtggtgttgttatgcagacaatacaagtagacattaatttcatttttgaggtcttgttgtgtcagatcttgggagtatacttttgtttaataggatttgcgatgggcatcgtagccgataacaaagtgttggatgcgttatcctttccaattatgatggtttgggcattattgattataccttttgatacgtggaccacaggaagattcgtcacgattatcagtgctgttcaaaagttgtttcctgggtattatttatttacgataatacagcatttgattgatagtagcagtcttggatatagtttattgcgttttgtagcaacgattgttatgactgctgtccctataggggtatttacttacctgcatattcgacggatgacgagttaatcacatttaataaatggggttgtgtttggatagaaaatactgagggaaaatagaaagcataaggtgcatatttgcatgttatgctttctatttttatgcattaagtcaatgtaaaaatgcattgatttaatgttgaattaatttttgtttaacttacatatattaatccactcttacaataaatttatctgaataaggaggtagcagttttgcaattaaaaagaatgcaaaaaacagattggtatttagtcggtattttaatactaagtgcctttttgtatggttggggtatatgggatgctggtagtgctaatagctactatacggcggctattacctcgatgacaaaaagttggtcgaatttttggtacggcgcttttgatccagcaggatttattactgttgacaaaccgccagttgcattatggctaatggccatatcagctaaaatatttggtgtacatggctggtcggttgttttaccaagtgttttgtcgggtataggatctgtttacttaatgtataaattattagcaccaaagtttggtttatgggccggacgaattgggtccttgattttaacattaacgccaacggttgttgctaatagtcgcacaaataatatggatgctatactggtatttttcttgcttttagctgtatatattttacaaaaagcagtcgctaagaaaaatatttggctagtcattgtcagttttggtttgattggtgtgggctttaacatcaaaatgttacaagccttcatgattttaccagcaatgcttgtttattattgggtagcaatcaaactaccgtggaaaaagaaaattgcttggttagttgttggtatggcttccttatcgatttttacagtagcctacccgttggcagttgattctgttgaccaatctagtcgaccatatattggtagctcacaaacgaattcattaatggagctagcatttggatataacggtaccgaaagattgttaggacaatcaacaggaactggcggtgctttccctggcatgggaagtaccaaaaaatcaacaggaactcaaaaaaataacggtgctccgagtggtaaaaagccgagcgggtcagcgccaactggtaaaatgaccggacaggcaccgaccggacaacaaaacggtggtaaagcgccaactggcacgccaccaaaccaatctacaaataaaaacgaaaaccaggctaaaggcaaagcacctggtcagtcaggaaaaatgaccagacaagcacaaggtggccagggtggcggtaacagtgcatttgctattggatcagctggaccatttaggcttttccaatcagatttgggttcacaaattggttggtatctgccacttgcaattcttggacttattgctggttggtttggatttagaaaacgtggtgctaaatggtaccatgtttctgaggaacaatctgaggttctgctctgggcgggctggttcgttccagtctatggatttttctcagttgctagcttctttcacccgtattacacaattatgctagcccctgcgattgctgcactgacagcaattggcgtagcggcggttgtgaaaatgtctgctcaaagcaataaagaatcaatgatcgcacgaatagtagtcagtgttgccgtattaacaacgcttctactgcaagcgtactatgtatggtcatattatcaaattatcagcattatcttgattattgtagcaattggcttatctatctggtggttattgcctagacaaatcaataacaaaataaaaattgtcttgtcggccattagtatcttactaatggcaggctggtggtcgttaacaccaacattgtcgcacaattctgcagcaataccagccgctagtccttccctgctaagtcaaaccggaagcagtgatatgggcggggaagtcaataatcaattattgagctacactaagaagcatcaaggcaatgctaaatacttatttgctacaacagattctaattcagcatctggatatattatcaaatcaggcaaagcagttatggctataggtggttataacggtactgatccaacgatgtctctatccgagtttaagaagctagtcaagtcgggacaacttaaatacttcgttatgggtaataatagtaaaacttcaagtggtcaaattagtaaaatactaacttgggttaaaaagaatggtactaaggtcacatatagttctagtacgtcaaatcaaagttccccaacgcaacaaatgggtggacaatcacaaagtacaacgctatatgatctatcaaatatatacgaataagaaaggagaatactttaaatatgctgacaagatttacaacaccaagacttgggttgattttaccagcctataatgagcaggaagttttgcctacaactttgtcgaaattgaatacgattaaagcgactttgattcaaaaaaatctcattagcgacgatagttttattatggttgtggacgatggctctgtagacaatacatgggaatttattcaagaaaaagaacaattaaattctgatttaattggtgtcaagttatctcgcaattttggccaccaatcagcattattagcaggaatgtcagagagtattaaattagcggacattgttataacactagatgctgacttgcaagataatccagatattattcaaaaaatggtgcttaaatataaagcgggcaacgaaatcgtatatggggtcagatccagtagaaaaaccgatacatggttcaaacgtaatacggcactaaccttttacaaaattttatcattcttaggtgttgaaatggtaccaaatcacgccgactttagattaatgagtcgtgttgccgtgctagcattactgcgactacctgagcgaaatgtttttctacgcgctatggtaccgctagttggctttcagtcagataaagttttctatgaacgtggtgaacgtcaggcaggtacatcaaaatatccattaaaaaagatgttgagttttgctattgatggcattaccagtttcagtgttcaaccgattcgtttattatttaatttaggcattcttgtcatcagcatcgccagtattgaaattgtttacacaatatttgaaaaaatgattggaaacacagaagcaggttggtcatctttgatgatttccatttggttattgggaggcattaacttggtagcaatatcgattgttggtatttatattggcaaaatatttaccgaagtgaagcaacgacctttatttcaaattgaaactgaaacagggctattcgtagaaaagctacgtaaagttgatgactatgccatgaagtgattttcaaggataatacaattgataatgatattgttcaatagtaatcaaagtactctttggatttgaatggagacaaatcgttttgcgtaaatatttactttctgaaaaaatgaagtatattttctggggtgtggcaacgaccatagtatatttaatcgttcgactcatttccatgaaaatatttgatgacacaatgctgcctgtcctaatctcgcagacactgaccattatattcgcatttgttgttaataaactgtttgtttttacaaccaaacaaacaaaaagcgtgttcgttcagttcgtcagattcctttggggacggttatttgtggccggaattgacttctttttaacctacgttatgatcgaaaaatatagcaatatttttattcatattttctttcttaatcaagtaaactttaagctatttcctttttcattaccaatagtaaaccaattcgcttcaaatagtacggaactaaatagttttctagcaattattttgatacaagtgttatcggtaattgtaaattatcttatttcaaaatttatgattttcaattaacatctttatcagctacctgtagataaaagtgatgactttatttaagaacaagcaagtttagagcagctatttgatatagctgttcttttttgtcaaaaaatcaaaacgattgctttctgtttagaattgttctagcatggtaggtaggaaaaggataacaatattaaggaggaattaggaatgtcaaaaacaaagattattatagttggtgcatctcatgggggacatcaagctattctagaactaactcgtaaatacaagaaccttgacatcaagttgtttgaagccggtgattttatttcattcatgtcttgcggcatggaattatatttggaaaatagtgttactgatgttaatgatgttcgtaatttccgtcctgaagatatggaacagctgggcgcagaaatttacagtaaccacgaggtactggcaattgatgctgatgatagaacagtttctgtcaaagacgttactaccggtagtactgagaaatatagctatgataagctgatattaagttcaggcgtgacaccaaatagtctacctgttccagggactgatttagaaaatgtctacctcatgcgtggtaaagattgggcaacaagtataaaggccaagttagaaaatcccgatgttaaaaatatcacaattgttggtgcgggttacattggcgttgaggcagcggaagctagtgttaaggccgggaaaaatgttactttaattgatatgattgaccgccctttgggaaattatttagatgctgaattaacagctgttctggaaaaggaattagctgataaaggtgtaaaagtggttactggcgttcgcatcgaaagttatgaaggaactagtcaagtaacggcagtaaaaacagatgagggaaagtacccgagtgatttagttattcaagccgctggggttaagccaaatacaaattggttgaaagatgtgattgatttagacgatcgaggctggattaaaacggatgaatatttacggacgaatttaccagatgtttatgctgtgggagatgcggttctatcgtattcaatccctgcccaaactaaattaccaattgcactagcaaccgttgtacggcgtgaagtccgttatataatcgcacatttatttgaaaatcagccctcagttcctttcaaaggggtcgttggctcgtcagcgttaagtgtgttcgattaccattttgcaacggctggattaaataccacaacggcccaaaaatcaggtgttactttgaagagctccttctaccaagataccttacggcccgactacgttcctcgagaaaatgggaacactgaagtttatgtcgagttgggctatgatccgcagacacatcgtattttaggcggtgcggtgctatcgacttatgatataacggctcaaggtaatgttattgcgctagcgatcgaacacggacttcgtttggaagatttggctgaagctgactttttcttccaaccaggatttgaccgacaatggagtctattgaacctagcggcacaacatgcacttggtgagcctaaattttaattagtttgtgaataaggtaatattaggctacaaataaaaagaaacgcaactcgaaaggttgcgtctctttttatttaataagtagaattatacgttttctaaatgaccattcttatccttagcaattaagaagtagaccgtcactgcgatcgaccatgcccaaacaatatgcccaaagaactcagaaatatgttcatctaaaggttgattccatggagctggaattgttccaaatgcaggcatgataatgatatgccaaagaatccaaaggaatataccataagcagcaccttgccacaaagctactttagaccaatattgagatacaaatacgtatagtattgcaaacgcaatggcaaatgagaagtgtagaatcaatgtgaaccaaaatactttttgatcttgagagtagtaaaagaatgaatgaactagtttagatggaatgccaagctgttcagccatatgttgtggtgggttagtggcattacgagctagtgtacgtggtggcaaaatattttcccaaccgattttaaccattcctgaaatcatccctgcaataaatccgtagaaaatacttttagtaatgatctcctttagtgatgcaactggtttatttagtgtaaccatagtgtttctcccttatgtgaatcatttaacaactgttaataatacagccattgggatcgtttgtcaattcatttgatttcgggaatatgttcgattaattatggatattaccaaaattgtgaaataaaatacttgtaattaaaaaacaatgagaataaaaataaatggttgcaaaataattataaatagtgtaaggttattacaaataaatgagacaaagaaaagataagtaaattttaggggtaatcaaagagagctaacatttggtgaaagttagtattacgaatgaattgaaaatggtcttggagtcgttagtggtataagcatgttcgtgaataccgctcgggtgcgcccgttatcgcgttaaggtatctctcttttgatgtacctgtcaagtataaagtagtgatactttatagaatttgggtggtaacacgagtttttcgtcccataatctttgtagataatgcaaagattatgggacttttttgttgatgaataaaatgaatggagaataagtaatgaccaataaattgtatgatgttttgactgtattaaagaagtttccatggattgatttaactatttttccagcttttattgatgtgggctttgaaacaatattgatatcggatagcaagcctatatcgtctacgactaagtcgtaattatcaattttaactttaaagaagtaactgcagttttaaagacaaagaaaagataagtaaatttaaagagtaactgaaagagagccgacgaattggtgaaagttggtgttacgaataagttgaaaatggtcttggagtcatagaatgggtgagcaagtatgtaaattcattccgggtgtgcccgatatagcacagagttttgttaaaaaacagaacttaaagagaataatttagtgatagattattgaatgcgagtggtaacacgattttcgtcccgcaatctggctatttttagctgggttgcttttttgtggtctgaaataaagggggtggtcataatagagctgaaaacagcctagttaaggtgatatataaagatgatgatttaaaatacttaaaaaatatagacgaaagaaagatttgaggagaaacagcatgagtgatcaaacactacaaaaagaactagaaaacattgaggtaacggatacactacaggcgtgtccgattgatttttcacaatcaaaggttgctaatccgcgagcgcatcaaaagcaaaaagaatatgacaacggtaaagacaagtccaattttaatgaacgagaaaagttttcagcctatcaaggcccccaatttaaagcccgttttacagacggtacgcttcctgttacacctaaccgttatcgcttgatttggtctcgtcattgcccttgggctaatcgtattgccattggtattgatttattaggtttagatcaagtgatttctaatggcatcgttgatcctttgagaccagctggggtagttggagactggttctttacgttagatgatggggatgttgatccagtattagggattcattcacttggggaagcttaccggttagctgatccttcatacgataaaagaacgacggtaccagcactcgttgacactcaaaccggtaaggttgttaacaatgattataataatttaatcaaagaatttgccttagcctggcaagaatatgtaccagaaactgcaccggacttatatcctaagaacttgcgttcagatattgatgcgttgagtgacatcatattgatggacatcaattatgcggttaatgaggcgggtcatggacgttctcaagcagattataaaaaatggtatgacaaagtatttaatcgattagattggctagaggagcgcctagccaaccaacgctacttattcggtgaccaaataacattagtagatattaatttatatgtcacgctgtcacgatttgacttagtgttttatcaaaagtattttgttaataaaaaacgtttagttgattatcctaatttgtggaactacgctaaggatttgtatgccatccctgcatttggcgacaatactaattttgaatcaatgcgtcaacgtttttatgaggttgatcatacaccgcaagaggatctgcctcgaattattccattagggccagatgatagtatttgggaagaagcaaatgacagagcagaaaaatttggttagtaatactcggaagttagcccagttaattgtagattccaagttccaaatagacgaattgaatgttgccaaaaaatgctttgtggattatttagcaagtgcctatgtttctagaaatgaaccagcggtgaaaagattatttgacacactcaaaaatgctggaccggctaagcttttaggtcaagctggtacagctagtagtgatcatgccgcattatttaatggattcgctgcacattacaatgatttcgatgatgttcaagctaattttcgcggccatccaagtgttgtcatttattcagctttgttagctcttgctgatgggactgaaagtgcagatagattttttgaggcctatattgtaggggtggaaattgctggacaagttggatttcaagtcaacccaacacacaagttatctgggtaccacacaactgcaacccttggtacgattgctgcagctgctagccttgctttctttaaacgtttttccttgggtcaaactatcgacattttatcatttgctgctacacaagctacaggtcttggaatggaggcaggtactgatactaagccaatgcatgcggggttagctgcacagcgtgcggtgcaatcttatcaatttgtgtccagccaacttacaaccaatcaagatgtttttaacaatcaaacaggttgggtaaaaatagttgttgggcaggaattagatttagatttaatagaatcaacatggttaactcctgctcaaattatcacgcctggcatctggtttaagcgacatcaattttgctctgctgctatgtctgggtatgatgcaatcaaacagggctaccttcagggaattaatataaaaaacatcaagcaagtaattttccattttagaccttttggagataaggtcttgcggtataagcaaccattgaatgggcaagaaggaaagttttcaattgagtacattgcgtggcaaatattaacctttggggatgtgaatgacaaactttttgatagcagtgtaagtacagaaaagtttcaagagatgagttatttgtttaaaagagttaatgatttaaagaatatagctgttgatcaaagggaaatactagttgagttcgtgcgtactgacaaatctatcaatacaatatatattgattggccccaagggtcaccacagaatccactaacaatggatgagatatatgtcaaattagctcatgcattgtcgatagatgaaaatgaattattcgatattttgacggcgggattgacatcgaaatcggtagcaggattgcttaacattattgcaagaatttaaagcagctaccctggaggaaaagtgatcactaatcgattcattaaaaaaaatgaagtaaaagaattacagctcttattacatgaagcgtataagagtgacacacaactaggtattaattttcaagcggcaagagttactttacaacagattgatgaacatatcgagaacacagcaacctttgtgacagagataaatcatactattgtagcgacggtatctgtcaggttaccttggtcaaaaaatccaggtccgtatgctatacctcatcttggatgggttgctactcatagtcagttttcaaagcaaggttatgcaacacaacttattgattgggttgaaaaagagtacattcaaaaacaactaaaagctccaatggttagtttaggaacagcggttgaacatccttggttaaaaagattttatacttcagttggttaccaacccgttgagatggtacaaaaaacgccggatcatttgacagtgtatatggtaaaagttttgaatagaaaatttgaccagttagagtctgaacaattgaagaaatatctaaataaaaataaaacaaaagtacgttattagtgagtaggtgaaatatgaattttgattggcattactttgtaaatacatttccagaacttgtgaaatatattccgatgacgcttttgttagcaatactatctatgttattagcgatagtattgggtggcataattacattactacacttttcgcattataaggttattcattggtttgcttcaatatatgtatctttctttcgaggaatgccagctttggtgcagctattcttaatctattatggtttaccacaaattttcccgatatttaaaggattgcctgccattattgccactgttattggtcttggtttcaagcaatctgcttacttatctgaggtatttagagcagcggtaaattctgttgatagagggcaaatagaggcaggacagtcacttaatatcaaaagttttaaaattttccgttatgtaattttaccgcaagcatttatcaatgccttacctgctacgggtaatacatttgttggtttgttaaaagaaacttcgttagcctttactttaggcataacagaggtttttgcagaaggaaagatgttggccggtgattcatttaaatattttgaaacatatttagcggtcggtcttacatattgggtgttaattattctttattcatgggcacagtctggggtagagagagtactgaacacgccatatagttagaaaggatagacattatggctctgattgaagtaaataatttatctgttgaaattaaaaaaaagaaaatactgcaggaaatcaatttttctgttgagaagggagaggtgacggttttggttggaccgagtggttcagggaaaacaacgctcttacgaacactaaatctgttacaagaaccttctcaaggtactataaaaattggtggaacatctattgatggccgtaaaattaacaaaaaatcaacgcgatccttacgatcggagtcaacaatggtattccagcaatttaatctatttaaaaatatgactgtcattgagaatgtgatggcacccctattgttaaataaattggctaagtgggatgaagcacatgacattgctgcatcagtcttatcggaagtaggattagtggcgtttcaagataagtatccaagttcactttcagggggacagcagcagcgcgtttcaatagctcgtgcaattgcagcaaaaccatctgttgtcttattggatgagccaacctcggcattagatcctgaattagttggaagtgttttaaaaacgatactggcattagctaaacagcatataacaatggttattgtgacacatgaaatggaattcgcccgactaatcggaaatcaaattattttcttagaaaatggacaaattgtccataaaggatcgcctgatcaagtcttgtcaagcaatggtcccaaaagagtcaatgattttgtaaattctgtttcaaaaaataattatttataagctgtattgaataaaaaagaaaagagaagagcgtatgaaaaaaaggaacccaatcattagtgtgattatcgtcgtagtattaattgctattgttgccgtaggcggtttgatttatcaaaccaataaccataaaaacgaagccaaaggagatactaaacaaaaagtgcttaaaattggcgcgacgggaaccagcttcccaacagcatacaaatcaaaaggaaaattagttggttttgatgttgacgtaatcaatgctgcagcaaaaaaagcaggatacaaagtacagtgggtcactggtgaattcgatggtttgctggggcaactagataacaataagcttgacactgtggctaatgatgttgctattacaccagaaagaaaagctaagtacaagtttagtaatatttataacaaagaagaaacaacagtagcagttaacaaagattctgattataatacattaaatgatttagaaggcaagacaattgctggcgcatctgcttcaaacaataccaaaaatttgcaagactataatagtaaaatcaaatttaagttatatgatgcccgtgacgtcacttttcaagctttactagcagggcacgttgatggtgtggttaacacacgtaataatttagaggcgttaatcaaagccaaaaattacccttggaaggttgtgaaagggagtgcagcaactgtaaatattgccttgcctttccgtaaagatgatagtgaaagcgcaaaaatattaaagaagctcaacccagcaatcaataaactaaaggaagatgggacgttgaaaaaactatccgaaaaatacttcgggtatgacgcaacagctgatttaaagtaacaggataagaacatgaggcaatataatggcaatcaatgacaaaacactagaagataaattaaccaaggtacgccatcagctgcaccaacatccggaactatctaatcaagaacaccagactacattgtttttaaatagttacttggaaactttaggttatcatattgtaacaccacaaaaattattgactggtgtgattgctgaaatagggccaagtgaatcaaacgtaattattggattaagatcagatattgatgccttaccaatcgccgaaaaaactgggctcaattatgcatcggttaatgaaggtattatgcatgcttgcgggcatgacttccatatggcttccttgttaggagcggcagaattattagctgaccaagctaataagctaaccggcagggttcgattaatttttcaacccgcagaagaaattcatgtaggtgcccaagctgtggcagaagctggtggtattaaaaacttgaatgcaattattggttttcataataagccggacctgaaagttaacgaaattggcattctatctggtggattgatggcggcagttgatcaatttaaagttacttttcgtggtcagggtacacacgcggctatgccacagttagggaatgaccccattgttgctttaacgaacaccgtcaatacgctacagaccgttgttagccgtaaaacagatccacaaagtccagttgttgtttctgttacacatattgatggtggtagtacatggaatgtattacctgatgttgcttggtttgagggtacggttcgaagttttgaccaggccagtcgtcaattagctcgagaacaattctatcaaattgttaacggccaggctgcaacttttggtttggcggttgatatttcctggattgaaggtccaaacgttgttaataacgatagtgagctgacgcccattgttatagaagaaaccaaacaacatgcgaaattactcacaccaaaaccatctaatgcaggagaagatttttcgtattttagtcagaaagtaccaagtgtttttgcatttattggtagtgcaggcacaactgattggcatcatgatgatttaattattgacgaccgtggtctgttgacagctgctagatggtatttctacacagctaaccggttattagcacattttagtggtacaaccacaaatgatagataggagaatttttaagaatggtagtaaaagcaataactgatgaacaatatcaagaagaagtagaaactggtgtttctatcgttgatttctgggctacttggtgtggcccgtgtcggatgcagtcacctgtgttagaaactgtatctgaagatagaaatgatattcatttttttaaagttgacgtagacattagtcaagaaacagctgcttcgcttggcattcgagctatacctaccttggtagtgcacaaagacgggaaaatcgttgaacgactaactggctttcataatagcgaacagctagtgaatattttaaataagtatgttgattaagcattagcagaggaagacattgaataataacattgacattattattcaatgtggatacaataagataattataaccaaaaactttgaaaagataagtacaaattagagtgattgtgtagagagctaacgtgaggtgaaagttagcatcataaaaatttggaaaatggtcttggagttaaattgatatgagcttaatgtgagtaaatgtcattcgggtgcgcccgttatcgcgttaaggtatatttcttttgatgtacctgtcaagtataaagtagtgatactttatagaatttgggtggtaacacgagtttttcgtcccataatctttgtagacaaggcaaagattatggggcttttttattgtcgtatgtagaaaaaataatggagaatggtctatgacaaacaaattaaataacatcttatcagaattgaaagaatttcagtgggttgatttaacccatacatttgggcctgatagcccgcacttcccagcgttcgctgccgcaaaatttgaaacactttttacacatgatgatggttttttcgtgaaacagtataccttcccaggtcaatatggtacgcatattgatccaccggtacatttcgagaaaaatcagaatgtatatgactcagatattgatctgaaagactttttactaccgttagtagtcattgacaaatcaagtgaagtagcaagtaatgcagattatattttaacagtggaagatattaagcagtgggaaaaggagcatggcaccattccaccaaaagcttttgtagcgttacgaacagactggtcaaagcgttggccatcacaagaacaatttgaaaataaggatgataatttacaaaatcattatcctggctggtctttggaagcacttaaatatatttatgaagagcgtcaagcaatagcaaatggacatgaaactttcgatactgaccctgccattttacaaccagaaaaagggtttgaaggtgaatattatgtattgagtagtggccattatcaaattgaactattggctaatttggaccaagtgccggccacgggcgctttaatttcaatatcagtgccgaaagttgaaaaatctcctggatttccagctcgagtatttgccatagttcccgaggaggtttgatatggcagagaataaaataacattatcacgatcactttccacaaaagatttggttgtttacggcattatattcatgatcccagtagcgcctatcgccttttacggttcatttctatcgccagcccatggtatggtggcgctagcttatctaatcggaatgattgctatgttatttactggatttagttatgctagcatggctagtgagtttccttactctggttcggtgtatacttacgttcaaaaaggaacaaatcctgtgttaggttttctatcaggatggggtataacgcttgattatattttaattcccgttataacctatcttatcagcgcgtctttcggtcagtcattgttgccggctgttcctttctgggtttggattctaggcatagccatatttaatacagttatcaatttattagggattaaagttgtatcgaaattcagttggttactttttgggttacagggcgtggttttaatagctttcatcgtggggactattgttgccttagcgaatggtacagttagttttaatgtcagttcgttttataatgctagtcatttttatttgtccggagttgttcaagcgactgggattgttattgtcagttatttaggttttgatgccattagtactttatcagaagaagctaacgacccaactaaatcaattggaaaagcgattgtgttgtcaattattttaatcggctcattattcgtcatcgttacattctttgcaggttttgttgcaccaaattatagtgaattaaatccagatacagcatttttaactattttgggaaaagtgggtggtagctggttagtgcatttagctgaattcactttagttttatcatttggtttggcgggtggtcaagaagggcagactgcggtatcaagaattttgtattcaatgggacgagacggtattttaccaaagcgcttatcctacttgcatccccgttataacacgccgtgggttgccattatacttgtggggattgtatctgttgccctttccctatcattatcgttaaccacagtatcaaatttaattagctttggcgccctatttggttttttgtcattaaacatagctgttatttggcatttttatatcaagcgtcctgataaaaatattgagtcgtttgtaaagtatttagtgtcacccttcattgggttttcagtgagtttgtggatatttttgagtttagctcttgaagcaaaattaactgggttattttggttaatcattggactcgttattttagtatataaaacgagtatttttaaaaaacctgtaccccagtttgatttttcagaataaattttcaatgctaatgatacaaactttatgtaaagagacaggagtagtaaatgtcaaagaaagtagcaattattacaggcagtggtagaggaataggaaaagcaattgctgagagactcgcgacagaaaattattacgttgcagtagtcgacattgatgaatctagtgctaaatatgtgagtgatagtatcaacgctattaaggaaaaccaagccaaatattatgttttagatgttgctgatcgaaaatcagtttttgatttggttgataaagtagtagctgattttgggcgtctagatgtatttgttaataacgcagggattgcctacattgatagcattatcgatagtgatccggaaaaagttgagcggttgtttgatgttaaccttaagggcactttttggggaatccaggcggctgcaaaacagttgaaaaagcaagggagtggcggaaggataatcaatgctgcttcactggctgcagtggaaggatctgcactacaaggcgcatattcagcttccaaatttgccattagaggattaggtcaatctgcggcaaaagaactcgcaaaatataatatcactgtaaatgcttatgatccgggtattgttattacacctttgcgcgattatattgatcagcgaacagcacaaattaaaaacacaacagctgagattcaaaggcaaagtgttgtcaatgaaattgcgttaggaagagcggctttgcctgatgatgtagccgatgttgtatcatttttggtttcacagcaggcaaagtatattactgggcaatcgattttaattgatggtggtatgagatttcattgatgttttgtaagtatttctaataaaaagtacaggaaagagaatttgagatggtaaaaaagaaaacggtagttatagcagctgttgtggcaggaattgttattgtagcaggtgtgattattcatagaaacacggcgcaaacaaccgataagacggaagtgacggtcggatcaataggatcggatgcccaaatttgggaatatattgcaaaactaccagaaaccaaaaaagaaaatatcactatcaaggttaagaacttcactgatggggtctcactaaatgcagcgactgcacaagggaaagtggatgttaatgcctttcaatcatacgcatattttgtggcttataacaagaataatagctcgaacaagttgagtgttttagggacgacatacttagagcctatgggcatttactctgaaaaatatgattctatcgacgatattccagatggttcaacaattgctattgctaacaatgcagctaacacggcacgtggattgaaactgctggcaaaagcaggattaataacattaaaagataattttggtagtctttctggcgttaatgatattaaaaacaacccacacaacttcaagtttaaagaaattgatgatacgaccgggccacgagtgattaaagacaattcgattgccgctgcacttattggaaatacaatcgcattggaaggcaaactgaatgttttgaaagattcactttactacgaaaaaattaaccaatcaacaaaggacaatattaatattctagccacagcagaaaagaataagaataatgctaaatttaaaaagttagttaagttgtatcatagtaaagcagctcaaaaatatattaacaaaaagtttgatggtactaaaatcgaagttcaaaagtctgtctcttatttagctgactagtttatcattagaatttccaaaagtaaggagttaacatggctgaaatttatgatttgattgttataggaactggttctgttggctctagcactggttattatgccactaagagagggttaagtgttttggaaattgattccgccacaccgccacatactaatggatcacaccatggcgaaactaggatgattcgccatgcttatggtgaaggttcatcttacgtacctcttgtattgcgtgcgcaagaactatggaacgaactaaaaagagacacacaagttgacatatttcatcaaacaggagtgctgaatatagcacctaagcaatcgagctttttaaataatatcataacttctgctgaaaaatatgagttaccgatcgaagtatatgatgcttctgaagccagaaaaaagtggccacaatttacaatacctgatcaattcagggcggttttagaaaagaactctggctatttgaaatcagaactagctattgatacgtatgttaaagaagctaaacggttgggcgctcatgaacaatttaacacgcaggtcatttcggttgataatgatgataatggatttgttcatgtgaccacaaatgcaggtacatttatagggaaatcggctgttataactgttggtacttgggttaaagatctgatacccaacctacccattcagccagttagaaaagttgtttcgtggtttgaagcaccaaaacagctggcagaagagatcggttttccagcatttacaattcaactcggtgacggtacacattattacggttttccagccaataaagggctcattaaaataggtcgacaccagggagggcaatatatcacgaagcgagaagaacgacttgacttcgatgcccttaatgaggatagaacagaaatagaacctttgttaaacagtgtcttgaaaactgttggcaacttggatcatggtgtggcctgcagttatgatttgtcaccggatgaacactttatcgttgacgatttaccaggaaagaaaaatattcagtttgtttcaggattaagtggtcatggttttaaatttgctagtgtgttaggcgaaacattggttgccaaagcgttaaatgaaacattggattttgacctctcaccatttttgttatctcggtttaattcataagaaaatattgaaatgctttagtaaaattaaatgatggcgtgaaaaaaagcaactactaatttaagtagttgctttttcaatgttcatgataaatttataacagttaaaaattttgctgaataagcataaagttgctaaaatagagggtatgcaaaatcagaagaattttctaactgaactattagttaccggacttggcggtgccattggtggggctacgcggtatcttttgggattagttccaataattggaccaatgccagtaatgacgatgttaattaattggcttggtactttgctattagcaatgttgggcgcctatctagcgagtcatcgcagtcggttagagcggtggcagtctttccttggtactggtgttttaggtggattcacgacatttagcaccatgatttggcaagtacatcaacagttattcattagcgtagccaatgctttagtttatatgatattaactcttggtggtggtcttatcatgttaaaattgggtaactactttggcaacaagatcggtgaggcacatgtatgacaatactaggggtagccattggttcggcattaggtacaatgctgcggtatattgttctgaatacgtggtcagctaagtcgaaatactttactgccgtattcattgttaatatggttggcagtttcgcgctaggttatcttatggctacaggcgcaacctatgcgatgcatagcttttggacgacgggtgtaattgcggggctaacgacttttagtacgatgatgacacaaagcggtcaatacactcgtggccaacaagcttggtacttagcttggcaaatcatttttggtatgattttctttagtgcaggtactgcgctaatcacgatattatgaaagaataccaaattaagttgaacatattaatgaggacaaaataatgagtaaaatagcagttattattgattcatcttcggcaatgccagtagctatccgcaaccggtatcatatttttcaagtgaatgatcccattatttttggggatgaagtctacaaggagactgtggatattcatagtttgggtgaacttgttaaaatgatgcaagaaaaaaagcaattggcctccacatctcaaccggcccctggcgattgggaagaagcgctgaacttagctaaagcatccggttacaatcaggccattttgattacgctttcatctggtatttcaggcacctatcaaacagctaatgcaattgcgcaatcatatgacggtatggatgaagttcgcgcgtgggattcaaaaatagcagtaatgggtgccggtgtgcaagctatattagcagctgccatggcggagaaaaaccgttcacttgatgaaattattacatcattagaacaactacgatcaaccattgacgttcgcttcgttgtcaatgatatttcacatttacaacgcacaggtcgcttatcacgcggccaagctttaattggtggtttgttgaatatcaaaccaattttgtccattgatgttcaagacgaagggaaaatcggagctgttggcaaggcacgcaagatgagtggggctttaaaagaaataaaagaaccattacgtcagtcattagcagaagctgattatcctgttcgggcctatgtaattgatggtaataacacgaagttaggcgataaatggttgaaagatttacagtctgaatatcctaccgttaaatttgaacgtggtgtgattggtgcatttattggcgtacatacaggcgatggcgccatgggtgtaatctgggcacgtgattgggaagatttaatttaatcggtaataaaaaccagtatcaaccaaaattggtgctggttttattgtataattaagaatagaataatttacggggtttactaatgcaacgatcaagacgttttcaaattgtttatgaagtgctcaacgcggtcacgcacggatttgggttcattttagctgtgattgccggtgtaatgttgatgattcatgtgttgagcaaaccagttaccgcattgactttaactgcggttatcatctatattagtacggttggtttttttctacttgcctcaacgctatttcattcgctcgtgtttacccgtgcggcaaaaatctttcaattttttgaccatgcaggcatatatcttgttatcttaggtagttacacgccctacacatggttattgattaagggctgggttggctggactatttggggcgctattttagcaatgacgattgccggatttgtttatgatttattttttgttggacgatggccttgggtatcggtgacgatttatctggtcatggggtggttgattattctagcaatgcctattctttggggcgttttgtcgcataccgccttctggttacttgttgctggaggcttgacctattcggcaggaactattttttatcttattcctaaaattccaatgggtcatgtttattggcatctcttcgtcttaggtggcgctggattaatgtttgctagtatctacatttctttgtaaaagccgttaggctttttttttatgactattttcaaaataatgattactttattaaagttagttggttgcgtaaataaactaacggttgtataatgtatttgttgtaagcgcttccaatataaaaataaaagtaaggagaaatcatgttgaaacgtaaccctatctcaaataattttatttatttttttggagcccttggtggcctcctattcggatatgacacgggtgtaatatctggtgctatgttattcatcggaaaagaattagaaattcagacaggatcttttgaagatggattcattacggcatctgtattgcttggtgccattcttggtgccgcaattataggtccaatgtctgataaactaggcaggaaaaaacttcttttatcagcagcgataattttctttgtaggtgctttgggatctggaattggttttaattacacactactggtcacttcgcgggtattgttgggtatcgcagttggagcggcttcagcattgattccaacttatctggcagaattatctcctgcagacaaacgtggcggaataggaaccttatttcaattaatgatcatgacgggaatatttcttgcctatgtttcaaatgaatggctttctccaagtggatggttaggactcgatcaaaatgtcggatggcattggatgcttggattagcagcagtgccggctgccctgttatttatcggcggtctttcgcttccagagtcgccacgtttcctagtcaaacaaggaaaaatgagtgaagcccaaaaggtcttatcaaccatgaatccaaacgcaaaacttgtagaagaagagttatatgatattaaactacaagcgaatataccttccggtggtttcaaggaactatttggtcccatggcacggccagtgttaataatggctttaggactggccatttttcaacaggttatgggatgtaacaccgtattatattacgcaccaaaaatattcatttctgcggggtttagtgaacattttgcactccaatcacatattgttatcggattatttaacgtgattgttaccgccattgcggttaaaataatggataaaatagatcgaaagaaaatgctaacctatggtgcatcgctgttaacgatgtcaacagcaatgcttgttcttcgagcgggaaatggtagtgttggttcatggatatgtgtcattgctttgacgctctatattgctttcttttcggctacttggggaccagttatgtgggttatgataggagaggcatttccacttaatatacgtggacttggtaactcgtttggtgccgttataaactggacagctaattttgctgtgtcacagtcatttcctatgcttttaatcgcttttacaccagatcatgctattaatgcagaggggcaagggattgctaagctctttatcatttatggtgttttgtgctttgttgctatttggtttattgctaaatttacaatcgagactcgtaatcgttcattagaatctatcgaatcagacttgagatcaaaagcccatgcaaaaggctatctggagagtgactatgttgggataaaatagctgaactcatacgtattctgaatttttactcattaaacctatgcgcatcaagcaaatattttgtactgatgcgcataggttttttagtttaaacattcattgcttcatattccggtgtttggacgccaacttgaaagcatgtgtcggttaccgtacaatggaggtactgttaaaactaatagaaaactatttgagggcatttcagatgaaaaagtcagatcatctaactattcgtgatcataatcagcgcttagttttacaagcgctttttaatgctgacgaaacatcccgggcgcaattagctattgatttaaacttaaataaatcgacaatcagctctatttaccgcgatttggatgagaaaggctttattgaaagccttggtgatggtgaaacttccgagacaggaggccgtaaagcaaagctgattcggtttaatcgacgttatgggtacgtcatttcttttgatatggggcgacatcatttgcggacagcactggttcaggttggtggagcagtgattatgaaacaaaatactgctgtggacggcatgagcgtattacaagtaactgagctaatgatatctcagattaaaaagtataagaataataaaaatggtaccttgaacgggctgatgggaatatcagttggtatccatggtgtcgttgaaaataacaaggtacaatattccccttttttcgattactcacaactagacatggcagtagaacttgaaaacgtcagtggcgtacgtgtggttttggaaaacgaagccaattttgcggccacctatatgcgcgattatcatgattatcgcaagtctgatcattataataatatggttgttttaaacattcactatgggattggcgctgggattataattaatggtgagttgtatcgagggatacagggtcgaaccggtgagataggtcgtagtgtgattgaaacaagtacaggtgagacagttagaattgaagatttatattctgaagatgctatgttacgaagaactgccgaacgaactgggttgattgttcaagatagggatcgattcattcaactgagaaaagaacaaccagagactgttagtttgttgcttgatgagtgggttcgtggtatttcacgagtggcatttaatttagtgcaaacactggcaccggaagctttattcattcattcacgttttattgctgaaatgcctgacttattagagcgcgtgattgtggcttatcaaatgttaaatccaatcaatcagtccgagatattatttgcaaatcactcagtatacgatgcaacattattaggtggggcatcgagcattgccagagaagtattagatttagacggtttgtcgcttagttttaggctataatctttttgtgaagcaggacagtaactacgctgtccctgcttttttataattgttacgttagtggacctagttaataagcttgcataaattaatgaaagcgtatacaattatcatagttggttggtgtaaccaactatgataattgtattaaattaatacaggaggataagtacaatggcagaactttttgattttccccaagtaacatttgtaggaacacaatcattacaagcgggtgatggatttcattattataatccagatgaaatagttaaaggtaagaaaatgagtgactggctaaagttttcagtgacttattggcatacaatggaccaacgcttagtagacccatttggtgaaggaacagcagtccggccgtgggacaatcaaggtaaaccagattcaatggagcaagcattggcgaaggttgattatttgtttgagtttttggaaaaaactgacgttaattactttgcctttcatgatcgtgatcttgcacctgaaggtcatacacttgccgaaacaaataaaaatttagatcaagttattgacaaaattgaacaaaaaatgcatgaaacaggtaaaaaacttttatggaatacttcatcactatttacgaataaacgttttttggctggtggcgcaactacaccatttgctgaggtgttcgcttacgcagctggacaaattaagcattcattagatattgccaagcgtttaggatcagaatcatatgttttctggggcggacgagaaggttacgactttctattaaatactgacaccaaacgtgaattagatcatattgcagcattttttaagctagctaaagattatgcaaatgaaattggttatcagggacaattcttgattgaacccaagcccaaagaaccaacacagcatcaatatgattttgatgtgcaaacaacaattgctttcttgaaaacttatggattagaggatacattcaagttgaacttggaaggcaatcacgcctacttagctggtcacacgtatgagcatgaagtgagatttgcgcgagaggctggtttgttagggtcattagatgctaacatgggtgataagctcactggttgggacattgatgaatttccaaatgatgtttatgaggcgaccttagtaatgtatgaattcttgaaaaacgggggtctaccaactggtggtttgaattttgattcgaaagcacgccgtcaaagtttccaagctgacgatttgttctacgcgcatattgctggtatggatacttatgctgctggcttgaaagttgctgctaagctaattgatgaccaagtgattgaaaatgttctgaaagagcggtatgcttcatttgattcgggtattggcgctgattttgaagctgggaaagttaccttaaaagaattggccacctatattgaaaataaaacagatgaagaaatcaacgcaaccctcaagtcaggtcgccaagaacgaatcaaacaaacattgaataattacattttttctgtacttggatcttaagatttgaatgtgtcttaagacattcaaattggtacgagtagtataaatattttcaaaagagactagtttaaactggtcctgtacataacacgggtgaactgtgttgggttatcttagtaaagatgaacagaaagtggaggctagacatgacaaaggtagtgcttggtattgatcttggtacctcagcagtgaaagtatcagcggttgatcggcgagggaacattgttgcacaacaaagctttgattatcctgttacacaaccacaagttggctggtcagaacaaaatcctgaagattgggtcaatggaacaactgttgcaattgttaatctgattttaaaagatcatattgcgccaacagagattgaaggaatttcttattctgggcaaatgcatgggcttgtcttgctagatgaaaaccatcaggtactgcgaccagcaattttatggaatgatacacgtaccagcgcacaagtagaggaaattaagaataaactaggtaaaaaatttcttgatattaccagaaactatcctctagaaggttttactttaccaaaaattttatgggttaaggaggaggagccagaaatttttaagcaagcggatcttttcttactacctaaagattatttacgatatcgtatgactggtaaattagccatggattactctgatgcagctggaacggttgtcttaaatgttactaaaaagtgctggtcaacagatattgcagaagcgtttgacttaccatcatcttttttccctgatctcattgcgtcaactgattttgttggtcatatttcagaatcttacgcgacattttccggattgacgacacaaactaaagtatatggtggggcggctgataacgccgctggggcaattggagcgggtttgctcaaatcaaacatggtcatgtcttccattggaacgtcaggtgtggttgcaaagtttgaagataatgctgatatagactatcatggagaaattcatttcttcaatcatgctattcctaacaagtattattccatgggcgtgacgttagcagctggtgacgccaattcttggtttaagcgtgtttttggtaaaacacaaagcttttcagcatggttacgtgaagctgaacaatcaagtgtaggtgccaatggtttattgtttacaccttatatatcaggtgagcgaacaccatatcctgatgcagatatccgtggaagcttcttaggacttgatcgcaaacatcaacgaggcgactttatccgtgcggttttggaaggcataatctttagcttcaaggatattatgacaatttatgaccaacaaggggttgactttgacacgattattgccattggtggcggtgcaaagtcaccactatggttacaaatacaagctgacatatttggaaagcgggtcacaacgctagaaaatgagcagggaccgggattaggcgccgcgataatcgcagccacaggattgggctggtttgacagtgtgcaagaagctgcacaatccttcctatcgtttggaatggtttacgaaccgaaggcagaaaatgttttgaagtatcagcaaatgtacagcatttatcaaacggcatatcgttcaactgcagaaatatcacacaaattagttgcttatcagcgtaaaatcagttcttaattgaaaaagaacttttaggttgaaaatatactacgttttctcaactagtaattatcaaatcaaaaaaaccactaaacaattgtttagtggtttaatagtggtcagccaggggctcgaaccctggacccacggattaagagtccgttgctctaccaactgagctagctgaccataatgtcgtgtttcacaacatcaaatataataccatgtgaaaatacaaaatgcaatagctaagtatgataaaatgaatatattctatattggaaggagatgcgtggacttttgcaccatttgttcacgctctattagcatgtttgatcttatcaaagcaataattattggtatcattgaaggcctgacggagtttttaccagtctcttcaactgggcacattatcttggcagaagcactgatgaagattcctggtggcgatgtttggacaaaatcattcagatcagtgtttgattattcgattcaattgggagccatctttgcggttattcaattgtacttcgacaaattgaatccattttcatctaaaaaaacagatcatgaaaaattccaaacttggcgtttgtggattcgagtaatcgttggtgtattaccagccattgtgtttggatttgcattaaatgacttcatggatgcacatttgatgaatttctgggttgtgtcagcaacacttatcatttatggcattgcgtttattgtgattgagaaccgtcaaaaaagcattgtaccggtaattactaatgtaaaccaaattacttttaaactagcattgtatattggtttgtttcaagtgctgtcaatcgttcccggtacatcacgttcgggagcaactatcttgggtgctattatcttaggagcatcgcgattcgtggctgcagaattttcattcttcttgtcaattccggttatgttcggtgtgactttccttaagatgggttcattctttagagatggtggttcattcacgggcatgcaaagcatagtaatgcttgttggtttcatcgtatcttggattgttgcttggtttgctattaagtttatgatgaactatattaagaataatgatttcaaggtattcggttactatagaattattataggcgctattttcttagttttcggtattcttggcatcgtggggtaataaaaagcacaggcaatggcttgtgcttttttgtttcatatttttattcataaaaaaatatttaaaattaaaataaaaagtgattgacatgagaaaatgcatagtatataattagttcaacatataacgttgaaaagataagtacttgtcaaaatgattgtatagagagctaatgtttggtgaaagttagtatcaggatggctaggaaaatggtcttggagttaatagtgatgtgagcaataaggtttgtaaatatcattcgggtacacccgttacagtgtcagagtatcgaaagcattgtcttttctgtacttggtaagtgtgtactagtgatagtatgcagaaaacgggtggtaacacggtaacttcgtcccgcagctttgattattcaaggctgcgtttttttgttgtatgaaataaaggagaaattgatatgcgctatttgttaactaaaaatatattagttagattaaagggcttaggcatagctcatagccgaatgtgattctgtttattaactttaaattaatatcattaaggagatcacatggaaagcacgggaaaattatcctttactaataattacaactacgttccagcgagtttttggtatcatttttcggcagcctcaggtgtagagctggatgcttttaaaaatcctgagattattgaaggtaatattttaggtactaagaagttagttgagacaacctcaccagattttgtgaaattaatgagcgacggcctgtttcattacgaatttaattaccaagatgctgatgataaaagggtagtttacgctaatttatcaccaatagcggataatcatccatggttgataaaaacagcagatttagttagacggcaaaagcaggtcatcggtgagcgagcttcattttataatgttttttcaccaacgacgttacttaaatgggcactagttaaaaatccagatggacactacgataaaagtaaagccgatgaaaagcttgctgatattattttgacagatagcgaaaatgttcgtcaggcattagaggtgattacactagatgtaatcaagcaggtgaaggctgcggtcaatgctggtgccgatgggatctattatagtacgcaagttattcaggatccacggctaggacatgccgattttgatgaatttgtcgctgcgactgataaacaagttctaaaggcagcaaatcaattgtcagatacaaatatcttacatatttgtggtaatggcggcgccagaaatgcaatttcatggtttgaaaattatccggcatcaattgttaactggtcagttgatacggaagacatatctttacatgagggcaaagagatcttcccagggaaaattgttcttggtgggtttggtaacactgcgaaagatgttttgtatcgaggaacacagtctgaaatacaacaatttgctaaacgtttagttcaggaagctggtgccgataatttaattattggtgctaattgtacggttccccgggatattgatcctcaacatctacagtgggcgatagaagcagttcaaaaggaaagtgaaggtttgaaaagttatgagtaatcaacaaaatgtattattagattcaacagaaaaaataccggttagtttttggcgccatttcgctgatgatgaaaccgtcgacgcattagaaaatccaacaattgctacgattaatattcaaggacataaggaatatgttgacgacttacgtccagattttgtgaagttaatgagtgacggttattttaatgttccttttgacaatgtcactgatcctaaaaatattgataatttaagtaaaattcaagagatacaagatgatgatccttggcttactgaacaagtcaaattagtgcaagagcagaaaaaagttattggtcagcgtagaggtttttataatatcttttcaccagtgacgattttaaagtgggcactctatgatgcagaaagtgagttgcctgccaagggcgatgaacgcttaaccgaactgtttattcaatacccggaggaaattaagcatattctaaatgttctagctaagaacattatcaagcaagtaaaggcggttgtagtacatggtggtgctgatggagtctattacagtacacaagaattacagagttcaaaatatactaaagaattgtttgatggtatacaaaagaatgttgatttaagtgttatagatgcaattaagtctgttagtgatattagcattcttcatatctgtggtttcagcggtacaagtaaccacttagagtggtttatagactatgacttgccaattgtcaattgggcagtgacagtggaaggtgtttccctccaacagggacaacaaatatttaaagacaaagttgtattgggcggatttggtaatacaacagatgatgtattatacaacgggtctaaagacgaaatagaggcggctgtacaaggattattgtcccacgttgataaaaagcgtgttattatcggtgcggattgcactgttccccgcgatattcctgtggatcatttgaagtgggcgattgccgccgtacatgaaaacgttgtgtaacgaggagaagagagaatggtaaataaaaaagggattattactgctgcggtagccgttgtcattattggtggtggtttgactatacgtcatcttaatgcagacagcaacaaggcagcagccaaaaaagtaagaacaattaatgtggcacatacacaaaactatgtgccatatgattatgtgaaaaacggtgtatcaaaaggatatgaagttgatgttttgaaagctgttgataagctattgcccgattataagtttaagtatcatccaacatcagatgaagatttattagttggcttggattcaggaaaatatgatgttggggtgaagggtgcttggtggacaaaagaacgtgccaaaaagtacatcttacccaagcaagcggttggtgcgtctatcataggaatcacttatcgaaaagatgataactataagtcatttgccgagtttgcaaagaagtcaggtaagttggtaccaatttcaccacagaatggtcaatacgcagtagtacaggagtggaacaaaaaacaccctaacgaaaaaatcacattaaaatcagctgatcaatttactgttggtgatgcatataactgggtattggaaggccgatatgatgcttactttgatgtgaaggtaaattaccaaaattcagttgttaagagcagtggcgcttaccatagttcagccgacaaattggcctacacaccctacaagggcattaagacttatccgattatcagtcgtgccaataaagacaactcaaatttctcaaaagaatatgaccaagctatcaagaagctacagaagaacggaacgctggaaaagttgtcacaaaaatatttcaaagaaaatgtttgggactttgtcggtgataaataaagtttcagaattaaggagttaagatgccaccatttagtttcaaatttttcctatcggtttttggtgaggtactgccttattttccagtaacgctactcatcattgttacatcgataatttttagttccttattaggggcattggtggctagtgggcaacttagtcgatcaccaatatggagaaccttgtcacaaggttatgtttttgtactgcgctctacgccacccatcgttttgttgtttttagttttttatgggttacctaaattattattgctatccttgaatattaatatcaatgattggcaaaaatcgattttcgtcattatcgcgttatccttactgtttgcgtcaaatttagcagaagtgtttaaatctgcctatttatctgtgaacactgggcaacgtgaagcggcattgatggtgggcttatcagaatggcagacattttatcgtataaccctaccacaaacaatcgtagtcgccttacccaatttcgcaaatactgtcgccgcattaattaaagatgcagctttggcatatgtcattggactactagatatgatgggtgcaggtgataatctgatttctaggaattttggacaccactcacttgagacatatttagcgttggccattatttattggattttatttgtaatcattgagcaaggcgcgaagtatttagaaagatatcttggtaaaagccgtgcaattgcatcaaatcctgcggaggttgtcgcatgaatgtaccatttttaattcaaactttctggtcggctataaaagctgtgccaataacattattaattaccggtgcgtcattgctcattggtttgccgcttggctttttattggcatggattaaaattagaaaaattcgtatactttatccgctcgttgtcgcatacacatctctcatgcgggccacgccgatggtattactgattttactgttttatagtacattaccaagcttgttgaatgtcttagttaaccaaaaactacactggaatgtcaaggtgttcgatactaatcccattatttatgccattattgtttttgctttaattgcagttgcaaatttatcggaagtatttcgatcagcaattttgacgattgatcctggacaaaaagaggcagctttaatggttgggttgacgccaatacaagcttattatcgtattattattccacaagcattggtttcggctgtgcctaacattggtaatttaacgttaaacattttaaaaggcacttcgcttgcgttcatgatgacggttcaagaagtaacggcggttgctaaaacagcagcctcatatacttatgattacacggaagcttatattgatatttttataatttactttattttaggaacgatactgcaaatcatttttaaatatctggaacgttacttaggtcgacataagctacgcggaacagttgtatagggagaataacatgttaaaagtcagaaatttcagaaaaaagtatcatgaacatgaagtattgaaaggaattgatattgaagttaaccaaggggatgtagtagcattacttggaccatcaggatctggtaagactacgtttttaagagggttagcttttctaacaccgggagattctggtgttatagaatttgatgatcaaaaaataagtattgaatcggcaacgcctgttgatattaaaaagttgcgacaaaagatgggcttcgtttttcaaaatttcaatttgtttgctaataagacggccatacaaaatgtcgaagaagggttgattattgggcataaggagccaaaagaaatagctcgaaaaaaagcgcaggaagccttacaaaaagtaggtttgttggaatttgccaatcattatccaagtcaattgtctggtggacaagcgcagcgcgtaggaattgctagagcagcagctttaaatccggagattattttattggatgagccgacgagcgcgttagatcccgagttagtagcagatgttttgcaggtgattaaacaactagctgatgaagggaaaacgatgattgtcgtcactcatgagatggcttttgctcgtgatgtggctgataaagttgtttttatggataaaggtttagttgtagaggaaaatgaacccgttgaattttttgataatcctaagtcgccacgtttgaaagaatttttaagtcgtattagcgctgccaatgttgctgacaacagttttgagtatgaaaaggctaatcaaaaataagttaaacgcgctctttagacttgcagcagcatctagcggaaaatgtttcacgtgaaacggataaaaatatttaattggttactagcgattggcttgtttttcaggtaaactagatactatggaaaactttcaagaacaactaaagaaccgacgtacttttgcgatcatctcccatcccgatgctggtaaaacaaccttaactgagcaattattgttgcatggtggagtgattcgtgaagccggaacagttaaaggccgtgggtcgaacaaattagcttcatctgattggatggcgattgagcaacaacgtggtatttcagtaacgtcatctgtattgcagtttgactatgaaggtaaacgaatcaatattttggatacaccggggcacgaggacttttcagaagatacctatcgtactttgatggctgtggattcagtagtcatggtagtcgatgccgccaagggtattgagccacagactaaaaagttatttgaaattgtctcacagcgtggaataccagtctttacgttctttaacaaaattgatcgtgacgctcgcccagcacttgatttggttgacgagcttgaaactgtattaggaattcaagcttacccaatgaattggccagtcggctccggccaggttctgcaaggcatttatgatttgcaggctgaccaacttgtgccctttaagaatgctacaattcattccgagatcgtcgatgaggcgatggatgaaattgaattgttacgtgatgcgggtaatccatttgatgaggataaaatcgctcatgggcaattaacacaagtattctttggctcagcgttggttaattttggtgtaacagaattcttgcgtgaatatttgacgtatgcaccagccccagcagcgatgacgacagttgatgacaaaaaaattaatccagaagacgcccagttcagtggttttgtatttaagatacaggccaacatggatcccagacatcgagaccgtattgcatttgtgcggatcgtgagtggggagtttaatcgcggtatggatgtgttattacaacggaatggcaagaaattaaagctctcgaacgtgacacaatttatggctgaagaacgtgaaaatgtccagacagcagttcctggtgatattattggtgtctatgatacggggaatttccaaataggtgatacaatctactctggaaagaaagctgtacagttccctgatttgccaacatttacacctgaattgtttaaccgtgtggttgccaaggatgtgatgaagcaaaagtcatatcataaagggattgaacaactcgttcaagaaggaacaattcaactttataaatcatggaacggcggcgactacattattggcgctgttggacaattgcagtttgaagtgttccagttccgtatggaaaacgaatataatgttgaaattcaatttgaacccattggttccaaagttgctcgctggataaagccagaacaattagacgagaaaatgagttcatcacgtaatttactagtaaaagatcggtatgatgaaccagtattcttattcgagaataaattcgccttgaattggttccacgataaataccctgatgttgaattagaagaaaaaatgtaaaaacaccaagcatattggaacgtctgtggacgttcttttttaatatcgtaatatgttagaatatagtaacaagaatattggagaaaatcatgtcatattatacacaacaactttttaatggccaacgcgatcgtattttgcgtgttgttgattcagatgatgctacacaagcaactgctggttttattcatatttttgacgaacggcgagcttttgactttgaatacgctaaagaattaacgaatggtgaaatcacacaggaacagtttgatgaggaaggagagtcggttaacacatttagcgttaactttatgcccctagcgcatgctgaagaggaagaaattcctaatgaattgtttgaggaatgggctggcctaattggccgtgaatatgcattggttcccaacttacatatgaatatgtatcaacagtctctgaaacctgaaattgaggaaattgataaggatcttttcgaagaaagattgttagaattagttacacgtgttcttggatcttctgttgttggatttgaagaaaaagctttgacactttacccaagctttttagtacaagagcaacctgaacaatccgaacaaaaagggccatcaacccagataatattaccagaatagtgaatatatggattgatgaatagtatatttagctaatttagcgaacgttttgtaagcattatcgttaacgttcgtttttttttatggtacaatgtctgggtcgataagacaaataaaatcggggtagattggtgcgcgttaagtgcagcggagacggaatgtgagccgctgacgaaacaaacattcattgctagcatttttttcgtgttagcaatgaatgtttgtgcggtgcatcagtcacattcaccactatataaggtgaacactccactcggaggttctatagcatggaaaatacaacacgaacgtgggttttcccaaaactagatacgcgccaattcgttttattggcgatgttgatggcacttcacatggtgctgagcaggctgacagtcggcactaatgtacttcaagtaagctttgcattcgtaacgatgtctctgattgctaaatggtatggtccattgtggtctatgttaattgcggcaatattagacgttatcggcgcaacaattattaatcctggtgcattctttgtgggattcacttttacagcaatgattagtgcgttaatttattcactggcttatttcaagcatgacaaaacaagctggtggcgagtaagtgttgctgtggggttggtattattaattgctaatattggtttaaattccatttggttggttatgatgtatcatacagcacacgattggccttcatttttagcctttattacaccacgtgtcattaagaatttaattatgtttcccattcaagtgggtatttcgtattttcttttaaataatcaggttattagtcacaccacaaaaaagatttttagttaaacagcttcggctgtttttttgaaagcagaggttttaatatggtaaatgaatttccacaagttttaacaatagcaggttctgattcagatggatcagcagggatgcaggcagacttgcatacatttttcattagaaaaacatacggtatgagtgtgttagttgctgctgtggctggtaactcatacggtattcatgctgcggaaacattaccgctacactttgttgacaaacagtttgaggttcttgctgacgattttaaagttcgcgctagtaagacaggcatgttatcagatgctagcttaattgaagcagtggtaaaagcttataaacagtttgactttggtcctttagtagttgatccggtaataacaacaaaacatggtgctcaattgttagaggcagcggcctttgaggcactaaaagaaaaacttctaccactggcaacagttgcaacaccgaacttttttgaggcacaattgctaactggacgtactattgataatgaacagcaacagacagctgctgcaaaagatattcaatctctgggcgttcaaaatgttattgtcaaaggatggcataatcaagataaacaaaatgaggttgctgactatgttcttctcgcggatggctctgatttttggttaaggcacccgtattttgatactacacacatcaatggtactggggacactttaagcgctgctattgctgctgaaattgctaaggggaaagacgttgcaacagctattcgcattgcccacgatgtgacggcaacagcgattgaacatgaaattgctgttggacataagtttggaccaattaatcactgggcagctcaagactataataaaaaagaagacaaatagtttgtcttcttttttattatgatgcaccggtgatatcaccatgaacaagtcgtttgaaaatatgacgatccgcccaagcgatattacgtccctgtaaaaggaaggacatgacagtgccaataccgagcgccacgatttgatggctaatgatgagacaaataatcgaaataccaattgcaacagcgaaattactcatttgagctttactagcattgccacggaaataatcaaagcgtaagatattcgtcaggtcatctaaggggtgaagaatccaattaacacgctggtatatggaaatagccacgccaattgtccaaataccaaacaagtcaagaggaatacgccaccaccaactaagttgacgaatgcccagcgagacaaagtaattggcgaatacgccaactaaaatactaaacgccataccgaagaaaatattgccgagtaatcgtaaccaattgatacgcatggctaaccacatatttaagaatgccacagaaacagctgtaatagctaaaaagatactaatttgccagccagtggtgttagataagttagcggcgcttgcagtccatggggccgaacccatggcgctagccacacttaatccattaccaaatgagttaatgattaaagagataaaaaagaaactaattttttgtttatatcccagttgataaaattgaccatctatatagtacattgtgtaattttttccttagttgattatcttcttattatagcattaagaaaggtgcttaaagatagtttacaaaatcacaattaaggtatagaatatatgcattagaaaattgtgaggaaaaaaacaatgtcagaaaataaagtcgctttggtaactggagctggtcaaggaattggacaggcaatcgcagaacgattgtcaaaagatgggtttaaggttgccttagttggacgtcatattgaaaaagtacaaaaagtagctgatgaaattaatgaaaatggtggtgaagccattgctattaaggctgatgtggctaaacgtgatgaagtttttgcagccgtcaaagaaacgaaagaaaagttcaatggttttgatgtgattgttaacaatgcgggtgttgcgcctacgacaccaatcatgtcagtaacggaagatgatatgaactggacatggggcattaatgttaatggtattgtctggggaacacaagctgcgacagaagccttcaaggaatttggtcatggtggcaaaatcattaatgcaacatcgcaagctggtgtgcaaggaaatgctaatttgactgcctatggatcaacaaaatttgccattcgcggtattacacaaacaacagctaaagagttagcagaatttggtattacagtaaatgcatttgcgcctggaattgtgaaaacaccgatgatggaagatattgctcatgaagtaagcgtgaacgctggtaaagacgacgaatggggaatggcacaattttcagaaggaattaccttaggacgactaagtgaaccggaagatatagcaaatgtggtttccttcttgtctagctcagattcaaactatgtgacaggccaaacattaattgttgatgggggtatggtatttagttaaattcaatatataactttaaaggcatctcaatttctttaattgaggtgtttttttgtgcactaatctaaatatgtgatttattgtacaatatatatattattatgttagcgctaacaaaagcttttaaataagggtttaagaaacatattcaaaaaaggttgctttttaaaaaagaatgatatatacttatattgttaataaatgagcaagtaaaggagcaaagattatggcagaagcaattgcaaagaaacccgcaaaaaaggttttgacccctgaagaaaaagcggaattacaaacacaagctgagaagatgactgaggtattgattgaaaaatcacaaaaggcattgtctgaattttcaacattttcgcaagaacaagttgataaaattgttgcagctatggccttggcaggttctgagaattcacttctgttagcccatgctgctcacgacgagactggacgtggggttgtggaagataaggatacgaaaaatcgtttcgcctcagaatcagtttataacgctattaagtttgataagactgtgggtgttattagtgaagacaagattcaaggtaaggtagaattagcagccccacttggtattttggctggaatcgtcccaacgacaaatccaacgtcgacaactattttcaaatcaatgttgacagcaaagacacgtaacacaattatctttgctttccatccccaggctcaaaaagcatcggttcttgctgcaaaaattgtttatgatgctgctgttaaagcaggcgcaccggaaaactttatccaatggattgaaaagccttcactttatgcaacaagtgcgctgatacaaaatccttacattgcttcaattctagctactggtgggccatcaatggttaatgcagctttgaagtcaggaaatccatccatgggtgtcggtgctggaaacggtgcagtttatattgatgcaactgttgacacagatcgtgccgtgtccgatttgttgttatcaaagcgtttcgataatggcatgatttgtgccacagaaaactcagccgttattcaagcaccaatctatgacgaaattttaactaagttacaagaacaaggtgcataccttgttcctaagaaagactacaagaaaattgctgattatgtctttaagcctaatgcagagggatttggtattgctggtcctgttgctggtatgtcaggacgttggattgctgagcaagcaggcgtaaagattcctgatggtaaagatgtacttttgttcgaattagatcagaagaacataggtgaagcgttatcttctgaaaagttatcgccattactttcaatttataaagttgagaagcgtgaagaagctattgagactgttcaatccttgttaaattatcaaggcgcagggcacaacgcagcaattcaaattggttcacaagatgatccattcattaaagagtatgctgacgctattggtgcatcacgtattttggttaaccaacctgactcaatcggtggcgttggggatatttatacagatgctatgcgtccatcgttgacacttggtaccggatcatgggggaagaattcattgtctcataacttatcaacatacgacttacttaatattaagaccgtggctcgccgccgtaatcgtcctcaatgggttcgtttacctaaggaagtttactacgaagccaatgccattacttacttacaagacttgcctactataaaccgtgcatttattgtcgctgatcctggtatggttcagttcggatttgttggcagagtactaggtcaacttgagttacgtcaagaacaggttgaaacaaatatctatggttcagttaagcctgacccaactttgtcacaagctgttgaaattgctcgccaaatggcagacttcaaaccagatacagttattttacttggcggtggttcggcacttgacgctggtaaaattggtcggttcttgtacgaatactcgacacgccatgaaggaattttagaagatgacgaggcgattaaagatctattcttagaactacaacaaaagtttatggatattcgtaagcgaatcgttaagttttaccacgcacgtttgacacaaatggttgcgattccaacaacttcaggtactggatcagaagtcacaccatttgccgttattacagatgatgaaacacatgtaaagtatccactagccgattatgaattgacaccggaagttgctattgttgatccagaatttgttatgaccgtaccacaacacacggtatcttggtcaggattagatgctttgtcacatgctttggaatcgtatgtctcagtgatggcttctgaattcacacgtccttgggcattacaagctattaagttgatttttgataacttaacaaattcatacaattatgatcctaaacacccaactaaggaaggtcagaatgcacgcacaaagatgcactatgcgtcaacattggctggtatgtcatttgcgaatgccttcttgggacttaaccactcactagcacacaaaactggtggagaattcggactacctcacggtatggcaatcgctattgcaatgccacatgtgattaagtttaatgcggtaacaggaaatgtaaagcgcacaccatacccacgatacgaaacctatacagcacaaaaagattatgctgatattgcacgttacttaggtttgaaaggtgaaacagatgctgaattggtcgatgtattgattgcagaaatcaagaagttggctgcatcagtgggtgtcaatcaaacactatctggcaacggtgtttcaaagcatgactttgatacaaagttagaaaagatgattgacttagtttacaatgaccaatgcacgccgggaaaccctcgccaaccaagcttggcagaaattcgtcaattgttgaaagatcagttttaaaaaaagagaccttacaattaagtaaggtctttttatttttgacgttttgttaatttaacaacgccctcccaacgggcagtttgagggaacatgtcaatactttgaatgtaatcaacttggtaggcttttgataaatcaaccaaatcacgagccaaagttgaggcgttacatgaaatgtacacaaacttttcaggttgtgtgcgcaaaatttctcgacgcagtgcagtgtctaaacctgtgcgtggtggatcaacaactaatgcatcagctatccatccttctgattgccatttaggaaacagtttttcagccgtacccacttcatagtgagcattattaatatgatttaaagtagcattttgattagcatcatcaactgcttcggggataatttccataccacgaacttcgccagccttgtcagctaaggacagaccaattgtacctacaccagcatatgcatcgactagtttatcagcgtgcgtcaaatcaagtgctgccaaggcttggttataaactacggacatttgcgtatgatttaactgcatgaaagcacgtggtgataattggaatgttttcccgagaaccttttcttcgatgtagtccttaccccaaagcttaagtgtctcttcgccccaaacgaggctagtacgaccaggattataattttgaaaaataccagtaacttctggtagggcctgattgattgcttcaatcagtgcggtatctcctgggaatccatctgtgtttgtgataaatgttagttgaacttcgctggttgtctgagatacacgagcaacaatagtttttaccgtacctcgatttttatcttcattgtagattgagacagataatttatcgagtaactcacgaacggtacgcatgactttcatcgtggctggggtttgtgtatgtacaaccggtaaatcaaccaaatcatggctaccacgtttatacataccgacactcagtttatcgccaatttttcgaacagggaattgggctttgttacggtattcatacggatgatccatgccgattgtgtcacgtatgtcataattagaccagcccttcggttggaatttttcaagcgattgaacgagtacatcttttttgaagcgtaattgtgctggataattcatatgctccaattcaaatccaccaacactatctgcgaattcatcaagcggtttcactctatccggagatttctcacgtattttcaagactttagcggcgatatattttggttctacttcagtaacctttacaacagccacttcatcaggtaaagcgccaggtacaaatacaatcttacgtttaaagtagccaattccttcaccgttaataccgaggcgcttgattgttaacgggaagttttggccaacacgtacgttgacaccttcactcgtgttgcctcttggtgcgccagacttacgggggtcaaagtttttaccataatatggttttttaccgttattgttgcgacttttttgataaggccgcttgttttgttctgtcatattcatctttctgcattgcaatgcccaaggttcattattatgtaaccatcataacatgatagcatgaaaagtcaggagatggggactacgaatgtttgataagtgtgataatagagtcgataaatgttttgaaatagtagtagtatccaacttaaagccaacacaaaggcaacaatctcgaaggttgttagagacagataacctacccattgaaataaaatcatactggttactaggattgcacagatgatataggatgttgcttcgaattcacgcggtgcatttggtagtagccagcggttgcccaacatcataattaaaataaagtagattaaaaaattggccatttggtcatgcaaaatatgaagacgtccagcgttgtttggaaacagaccgacaccagctaatgacaaagccgataaatttagcaatatgcgcaacgtaatgagccgtcggttgtgacgcagaattttttgtaaaggaacgaatagatagtctactaacgccaaccagattaacccagctagaatcaaagttgcgttaaactgccaagagtccagcgcattatcagttcctaaaaaacttaggttatattgccaccacatacgcgagctatttgtaaccatcgctgttagtacaccgccaatgatagtcattacaaaaattgaagtaatgaataaggtagagattgataacgctgaataaatcattaaaaagttaatgattccgttaaacatggtaaatagcgcaattgacgtgaataaatcaaacgatgcggtttgaaataagtaattaattgcccaaaagaatcctgatgtcacaaaagctaagataatagcaaaagctacggttaaagctggtaagacgcgccaactggttttacgacgcagcttatcaatttgttgtcgttgttgctgaaagtatattaaaaggaacatgaaaatgccgctgatctcacttaacataatgacggcactagcgatagagttgtcgccacccaaagggatacgaaacattttttcctccacggcataaattgtgaaaatgattgccatcaccatagaaggaatcaaaaaatgtcgcaacgacaatgtttgacgttcattaggattatttgtctgctgtatgatcaattgtccgtttctaagcgtgagatttagtggttgattgtgttttaaatgtagctcgctaacaatttcatcaggtaacgtaagttgatatggtgtctttgacataattctctccaatatgttctagtttagcatgttcataaaagaagattgaaagaacatgtattttttaatattttgtatttatatatcacatttgtgttataacaaatatgtggtataatatagatgtagagaggaacagaaaaagtagcagatgtgcctcagagacctctcgagttaaaggagatgtggataaatgattaaacgcagaaactttattaacgactttgtacacaatcgcgtacgaggtcagactgaataggatggcgattagcaatgagatttgatataaaggcttacttagatgataattcactaacaatttaccgcgtagcaaaggaatctggttatggatacacaacgatacacaagtcgtttaacaaaacacaatcagatgccacgagcctaaacatgcgtgatttagatgctctggctaaggtgcaacataaacaaatgtgggaagtgctgagggaattagaaaaactttattttgatgaatgataaacgtgcttggggtaagcacaagcacatagaaaactaaaaggagattttagactatggctaacaatgattttttcaatgatccatttggatcagacatgaatgacatttttaataacatgatgggcaatatgaacggcatgaactctgagaaccgtcgttatttgattaacggtcgcgaggttacgccggaagagtttgttcaatatcgacagactgggaaactaccacaaggtcttcaagcagccaatgctacaaacggtcagccagtagcacaacaagctgggcaacctggacaagtaaagcaggaaggaatgctggcaaagcttggacgtaacttgacgaaagaggctcgcgacggtttgcttgatccagtcattggacgtaacaaagagattcaagaaacggctgaaattttaggacgccgtacaaagaacaacccagtgctagttggcgatgctggtgttggtaagacagcagtggttgaaggtttggcacaagcgattgttaatggggatgtcccagcagcaattaaggacaaggagatttacagtatcgatatctctagccttgaagctggtactcaattccgtggtgcttttgaggaaaatatccagaaccttttgaaagaagttaaacaagcaggcaacgttatcttgttctttgatgagattcatcaaatcttgggagctggttcaaccggtggcgaagatggcggtaaaggactagctgatattatcaagccagctttgagtcgtggtgaaatttcattaattggtgcgacaacgcaagatgaatatcgtaacacgattatgaagaacgctgcactagctcggcgttttaatgaagtgactgtgaatgcaccatcacctaaggatacgcttgaaatcttgaaggggattgcgaagttgtatgaaaagcatcaccatgtttcattgcctgaaaacgtattaaaggcagcagttgactatgcagtacagtatattccacaacgttcattaccagataaggcgatagatttgcttgacatgacagcggctcacctgtcagctaagaacccagtaacagataaggtaagtttagagaagcagatgagcgatgctaaagcaaagcaagaaaaggctgttgctgatgaagactatgaggccgctctaaagtacaagaaccagattgctgatttggaaaagaaagttggtagcgctgacgaagctaaaaaggttgaggcaacgcctaatgatgtggccgaatcagtagaacgtttgactggtattcctgtggcacagatgggtgcgtcagatatcgaacgtttgaagacaattggtgatcgtttggctggtaaagttattggtcaagatgaagccgtaagtatggtcgctaaagccattcgtcgtaaccgcgcgggatttgatgaaggaaaccgaccaattggttcgttcttgttcgtcggtccaactggtgttggtaagacggagttagcaaagcaactagctttggacatgtttggtagcaaagataacattgttcgtttggatatgagtgagtattcggatttgacagcggtatctaagttaattggtacgaccgctgggtatgttggctatgatgacaacagcaacacactaactgaaaaagttcgccgtaatccttattcaattattctccttgatgaaattgaaaaggccaatccacaagtactaacgttgttattacaagtgatggacgatggtcgcttaacagacggtcagggaaacgtcgttaacttcaagaacacggtcattattgcaacatctaacgctggatttggacacaattcgagtgatgcagatcaggatttgatggctaagttggcgccatacttccgtccagagttcttgaaccgttttaacggtgtgatcgaatttagtacgttgactaaggatgatttgaagcaaattgttgatttgatgttagatgatgtcaataagacattggctaagaaagacttgacattacatgtgtctgacgaagttaaggatcacttgattgaagatggttatgatgaagccttaggtgcacgaccattgcgtcgagtaattgagcaacaaattcgtgaccaagtaacggacttctatttggataatccaggtgaaaaatccttaagcgcagacttggttgatggcaaagttgtcatctcggctgttgttgagaagactgcggttactaactaatgtttgaaaaaaccacgttcgtgtacaaaacgtggtttttattttgctttcaatgaacaatttattcagcatggtataatgaattcattaaactaaaggacgtctacatgattattcaacatgcaattctccatatactggatacgaatacaggtagtctcattgcatcgcaaggagaaatgaacgtcgacaatgttggcgttcatgaatatattgaaaagctggttaataaaatctataaaggtgacatcaagacaggaaatttattaccagatagttatctggacaagatgattaaacaatcggattttccggaagtaacgacacaaatggccactaaattatttgatacgattgctgctagtgagtctattccagctggtgatttgttaagttttcaggctacaattgatgaagggccaatctttggattaatcaaactcaattttggcgctcgttatgctcacgcagtagagtacgaagatgaccagatggtgaataacttggtgcttaatcagtcaattttaccggctgcaacgcaaacagttgatgaagctattttggtaaatgtcgatgatggcagctatcaattgttggaaaagaaacaattgattgacgggcatcgtgttccttatttttcagaaaattttttggaaataaaacctgaagtttcagcaaaagaaaatatccaagtcattaagcgtacaattaaaaatattgctgaaaaatatgatgagccagaacatgaggtactggctgcaacgcaggaagtgatttacaatagtttagcagagacgggtagtattagcacggatgttattgcagaaaaggtgtttggtgataacatcacggctaaacaagaatatcaagaaaagctgactgagaaatcattgccaacggaagtttcggttgttaattccgagaagtatgagaaaaagtatcgaacacaaaaatttaaactcgattctggaattgaaatttctattcctgttcatgtttaccaggatttgagtaaagttgaatttgtcaacaatgctgatgggacaatcaccttaatgattaaagatatcgcatcaatattaaataagttcaatgtgtagaggagaaaataatgccttatcaagattcttatgttgctaaaatacgcgaaaaaattgggcacgactttgagctcgtgatgcctacgatagatgtggtaattgccaattcaaaaggtgaacttttgatgatttataaccgtgattttgatggttgggcctttccaggtggttatattgagccagaaatgtcatggcaagaaaatgcagcacgagaagctttggaagagtctggcattcgtgcgaatgcaaaagatttgcaattgattggttctgtttcaggagaaaactatcgtacgcaatatcctaatggtgaccgggttaagctctatacaaatgtgcttttgctgacaaaatggtcagaagagttagataagatagacgatacagagattgacggaaaaaaatggatgacaccgcaaacaattgatcatgttcatttaaccttttccggtcgagcagtgtatcaggcatatcgtcaattccaagaaacgaaacaaatacaattgttaaccatcaatagtgaactgcagcgttttttggatgcgcaggatggttgcattgctgatgtgaatacgtatgaggatgcaattaatgaattgactgccggtcaaaaaagaacacattggatgtggtttgtattaccacaacttcgtgggctaggaacaagtgaacgtgcgacgtattatggtatcaaaaatgccaaagaggctcgtgagtatctagcagatgatgaattacgtactcgcttggagaaaattttaaaaattgtattgactattgaatcatcagatccagttgccatatttggacaagtagacgctgaaaagtttcgtgccagtgtgacgttgtttgcacaagttgcagaaacacctgatttgtatcagcaagttttagtgaaatatttcaatggtgacttacatcaaccaacactagacttattaaacaaataaaaaaggcgactaagtcgtcttttttatttgtttatactgttgtttttggcgcgtgcaatactagaccatgctctggtgttcgagcattaataacgatatcttcaaccttgaaaatatgtgccaattcactttcagtaaatctatttttcttttcagcgatttcacgcaaagattttccagtgcgcagagattctttagcaattttagcggcttctttgtagccaattattggcgccatcgcggttgcaaagctcaccgacaaatcaatgtcttgtgacaagcgatgtttgtttactgtaatgccgtcaatggcattgatgcgtagagtattcatagcttgttggagatgttcaatgccagtgattaagcttttgaaaataatgggttcaaatgcattcaattctaattgaccagcttcgcttgctgccgtaacggtggtatcaaagccaatcatttcaaaggcgacttgattgacaacttctggaataactggattaactttaccaggcatgattgatgaacctgcttgttttgaaggtaagttaatttcatgtaatcccgaacgtgggccagaactgagtaagcgtagatcattagacattttagatagattaactgctaaattttttaatgaaccagacagggcaacataggagtctaagtttgaagttgcatcaaataaatcatgggcttgctcaagtggaagcccagttatgctagctaggttagggacgatgtgcacttggtaatgataacttacgttaataccggaaccaatagctgatccgcccagatttaatgtatatagctcattgcgtgcggcttcgatacgtttaaagtctcgacgaagtggttttaaccaagcatgaaaggtatttcctaaggtcatgggcacagcatcttgtagctgtgtacgacccattttgtaagttgttgaaaattcgtcggctttgttaccaagagcgtctaccaataatgttaattctgaaaaaagtggttcgagtagtcggataagagcaatttttcctgcgctaggataagtatcattggtactctgacccatattaacgtggtcatttgggttaacgtagccatattcaccacgtgcacggcctacctgctcaagagctgtattagcaacaacttcattgacgttcatattggtacttgtaccagcaccaccttgaacgtcactaattggaaacattgtaagatcgattggctgacttaacaaaatttttgttgcatcaacaatatgtttagcaacagctcgatctagattaccagatgtagcatttgtttgtgccgcagcctgtttaatttctaaaaaggctcgaatgatttctggatgggttgtttcttttgaaattggaaaattatttagcgcacgttgagtgtgtgccccgtagtagacatctttgggtacgttgatttggccgagtgaatctgattctgtgcgcatattgcttctccttactggttatgagaatattttaccgcaaaaaataactataccaattttatttgttaagttttatgacaccatatttttctttcttgatatagaaaaaaagcaccctttaaggtgcttcaataatttcaacgccatcatcactaccaatgactacacggttaacaacatcagtgaacagaccgtgctctacaacaccgaccatattaattaattcttgacccaaatcacgtggatcttcgataacgggaacatgtagatcaatgaggtaatttgccgaatctgtacgtacagggttgccattttgatctaaacgccaagtaggatggaacccatctgcagtaaagcgtttaaataattggtcagatccatatggaataatttcgactggcaaatactgatttagtttggatacacgtttgctactgtctacaacccagatattctcacgagagttaaacgcaacgattttttcccataaaagcgcggccccgccacctttaatggctgagaaatcatccgaaatttggtcagctccatcaattgtaagatcaattttatcgacatcatcaacgttgtacatcgggattcctagttttgcagcattgcgccttgtcttttcagaagtagggacgccgacgatttttaaattttcattggccacgcgttcacctaaagcggtaatgacttgagcaattgttgatccagagccaatgcccactaccataccgtcctgaacaaagtcggcggcgcggcgaccagcaataattttttgtaaatcctgtgatgaactcatgatttgtactcaatctcctgataagtgtcggggtaacgtaaaaatgcttcttttacataaggacaaacgggctttattgtcatgtttttggcacgcgcatcagcaacaatcgtgtctaacaattttttagcaacaccttgcccacgtagagatggatccactacggttgaattaattgaataggtttgcccctcgttgattactgtataagtaatctgagcgataactttgccgtttttttccaagaaataacgaccattttcgtgttggaattccataataatttcctctcgttttattataacagcataatgattagcggtatttaattgagtgcgtgaaaatttactatttacctatgatactaacataatttgtgcttgtctgtgttacttgttctgaccattttttaatccatctaacattttataatttaacgtatattttttaaaataaggacaatatatcgtataataagggataaactatttatgaagaggtgtacttattatgacacgtggatttgagattgttagcaaatatgctgacgagaatattactgttccaaagcgcagcacacagcaagcagcaggttatgattttgaagccgcagtggatatcactatccctagcgttttgagtaataattttttcaagggacttaatattttatcacttgggaaactttcaaagctacgtgataatgaagatttgcaagatatgcttaaaccggtacttattccaacgggtataaaagcttacatgggggaaggtgaatacttgcaacttgtttcacgttcaagtggacctattaaaaaacggataatgatgcctaacgcagttggtatcgtagatgctgattattataataatgagggtaatgaaggggaaattttctttcagtttattaattttggccttaaagacgcccatattaaaaaaggtgagcgcatcggtcaaggcatatttttgccctatttattagctgatggcgatgatgctgtggaaaagtcagatcgtaagggtggctttggttcaacagggcaataatatcttttatcattatgttagaacgaattaaatgaaaggactaggatatcgctaaagtaaaaacacaatttatatgttccaactgcggttttgtttcggcgcggtatttaggacgctgctcaaattgtggtgaatggggcacgcttgttgaagaaaaaatccaaccagaatcaaatgatcgtaaaagtcgtgtgagtctagatggacgcaatgctaaagttgaaaaaataaacgagattacatctgaagagacaccgcgcgtagcaactaagcttaaagaactaaaccgagttttaggtggtggtgttgtcccaggttcgatggttttgattggtggtgatcctggtattggcaagtcaacattactacttcaagtatctggacaacttgctcaagaaggacgggtactatatgtgaccggcgaagagtctgccacacaagtgaaactgcgtgccgaccgcttaggcgttgggcacgatgagttttatttatatccggaaacggatatgacggccgtgaaaaagcagattgaggaattacaaccgaattttgttgttattgactcggtacaaaccatgcaagaacctgatgtctcatcggctgttggatcagtgtcacaaattcgagaagtgacagccgatctgttgcaaatcgctaagactaataatatttctatatttatagtagggcatgtgactaaagatggcgccatagcggggccaaaaattctggagcacatggttgatacagtattgtactttgaaggagatagtaattataagtaccgcattctgcgtgcggttaaaaatcggtttggcgcaacaaatgaattaggtatttttgaaatgcgtaatggcggtttgatagaggtagctaatccctctgagattttcttagaagaacgtttatctggtgccactggatcggcaattgtggtcgcgttagaaggatcacgacctattttggttgaattacaagccttagtaacgccgactgtatttggtaacgcacagcgtacagcagcaggcctcgataggaatcgcgtgtcattgattatggctgtattagaaaaacgcgctaacctattattacaaaatcaagatgcgtatttaaaggcagcaggtggcgtgaaacttgatgaaccagcaattgatttagcgattgctgttgctctagctagttcgtatcatgataaagaatcaaggccaagtgatgtctttgttggcgaaattggtctaactggcgaagtccgtagcgtagcagatattgaaggacgattaaaagaagctaaaaaattgggatttaagcgtgctattgttcctaaaaataatttaaatggcgtcgaattacctcaaggtattcaagttattggagtaacaacattaagtgaggcgcttaaaattgccttaggagaatgatcatgtcagagcatttctatcaatagttggctggttatcttgggaatgggggcacctactttggcagcttttaaaacaagtcgatgaaaatgggcattactacgcccatgataaaatacgtgccagtgaccaaacaaaaagccatttaggtaaacatttttaaatagctaaacataaaaaagggccttcctagaaaggtccttttttattatgaaggttgtaccagcggtgtgcgctttttttggaaagcaacaatagctaggtgaataataatagctacgatgccaatggtcagaagttgtagccaaagggtgtgtgtgttattgccaccgtataagatgttgtaatctgcgcgaattgaatagaaacaaggagaaatgttactcatgaccttgaaaaaatcaggcaggattgggcgtggaatgagaccggcccctgaaacaacttgagtcagcatgaaaggcatattgatcataataccaagttgtccaagaattaatgagaagattaggttgacattcaatgatgcaaataactcaatagaatggttaacccacagttgccaataggtattactatcaaaatgaagcatacttttgcttagtgcaacaattaacagcggtgctatcattgaaattaagataatagcgatttccgtataaatgtatgctttccagcgacctattaatggtgaaaatgacttgtatgcaacgacaattaacatggcgccaatcatggaaccaatataaaaagctagtgacataaagaacggagccatgctatgttgcataccagaaggtgctttattcatttttacaatgctgtaattgtatgaattagcaacgtttgcataggtttgatttatttttgctgtagcagtgttttttgtttgttcagctttttgtaaaatagcgtctttttgtgttggattagctgtgattaatgattttgtctctgattctaattgtgacaattcggtggctgttagaatccccttgctttgctgcagtaaaacacttttttgaacatgattaccgactgatttggcgacagtttccatggctgaaactgatgtcataggattggcgtagttgatgtaaaacttaagttcacctttagattgaccatctattttcttgaggttggcattgaaatcttttggaatatcaataattaaataaatttcgcgatcgttcaattgacttttagcctgtttcatattcaaatcagttttgacgtgtttaaacggcaagctttttttaagttgtttttttaatgtagtgctgtccttatcttggttgacaatggcaactggcaattggtttattttgctgggcacgactttataccctgaaaaataaatgccaaccatcaataagccgtagaatagcacgataatgagcgctccgatgacacccttgctgacaataaattttttgaaactcatgtggaactccttttcttttgctgacaatagagtagcacttattcgttttgcatgcaagtagttgcgtgcatactaaaaatagtctgtctttcaaaagagaatatgataatataactaaagaagaggtacgaaacatgtccaaacaaccatcaaaatacgatttaattttaaatgcgttcattacattgttgatagaagttggttatcaatcggcaaccatcaacaaaattgctgaaaaagcgaatgtcaatcctagtacaatttttagaaagtttaaagacaaagaagggttactatcagctgtgattgataggcatctcaatgatttggctgctatttttgatgatgcactggttgtgacgggtgatattgagactgacctaatcaatatgtcaagaacgtatcaagagtttcaggagaaacatcaagaagttgttttgataggccttcaagaatcttttcgaatgccaaaagtgagtcatgcggtcgaagaaataccaattcgattcagaaaaatcttactgcagtattttacagagatgagggcacaaaataaaataaaaaagtcggtagatgtggaagcagcggttatgaatgtcatatggttgaatttcggttattttttgactgcgattcgctatgacaatcctgagttaattactgaaccagaagatttctacgaaaagcaaattcgcttttttgcaaaaagtttacgtccataaaaacacgttatagtgattggaaattagtatcatgagtgttgtatactagtacctagacaaaacggtactaaataccatacataggagattattgattcatgacagaagacatacgtgttcgctatgcgccgtcaccaacgggacatttgcatatagggaatgcacgaacagctatttttaattggttatttgcacgccactacaatggcacattcgttattcgtattgaggatactgactcagcacgtaatattgctgatggcgaaaaatcacaacttgaaaatttagcttggctaggtttagactgggatgagagcccagacaaaccaggcgtttatggaccttatcgtcaatcagaacgtaatgaacagggtatttatcaagaatttatcgatgcactattagctagtgggcaagcgtacaagtcttacaaaacgtcagaacagctcgcctctgaacgtgaagcgcaacaggcagctaagcaggcgccgcattatgtttatgaatatgaaggtttgactaacgaagagcgtgaagccaaatatgctgaatttgaagcacaaggattaaagccggtagtgcgtttccgtgtaccagaagagcaggtatatgcttgggatgacatcgttaaagggcatatcgagattggtgctaaagaagttggtggtgattgggtcattcaaaaagctgatggtatgccaacttataattttgcggttgtcgttgatgaccatttgatgaaaatttcccacgttcttcgtggagatgaccacgtctcaaatacaccaaagcaaatcatgatttatgaggctttgggatggaatgtgccaaagtttggacatatggctttgattatcaatggagaaactggtaagaaattgtctaaacgtgatgaaaatctcttgcagtttgttgaacaatacaaggaattaggctaccaaccacaagctatggttaattttattggtttgctggggtggtcaccaaagggtgaagatgaaatctttagtttgtcagaattcaaagaaatgtttgatgaaaagcgtttgagcaaagcaaatgctaagttcgatcaaaagaaattagaatgggtcaacaaccaatggatgcgtcgtgatacggatgctgttatgccacaacttattcaagagctcgtcaatgctcatttgatatctgcagatgatgctgctgataagaaaaagtggttgtcagaagttattaaagtcgctggcgttgatggtatatcatatacgcgtcaaattgttgagctagttcgcaaacctttctttgagttgggcgatataacagatgaaatggttgaatacctgacttcagaagatggccgtaaagtggcagctgcgtgggaatcaacatatgaatccttgccgactgatgcaactccggccgactatatgagtacaattcgtgcgattcaaaacgacttagaaataaaaggccgtaacttatggaatcctattcgtattatgactactcacgaagtccaagggcctaatttaccagaaatgttgacattgttggataagaacactgttctgaagacaatgcgcgatgtgaaagaaaaatatttagcataggtatctaaacgtcgaggaatgctcggcgttttttattatgattttgagtatccattcgtactgaggaataatgccaaaatatttgcagctcatgtataatactaagtaataataatttttctattataaagggagcaaactatgatctacgtctacaatacgttatcacgtgaaaaagaagtttttaagccaattactgctggcaaaataaacatgtatgtttgtggtcccacagtatataactatatccatattgggaatgctcgctcagccattgcttttgacacagtgcgccgctattttgaatatcgtggttatgaagtcaattatgtttcgaattttactgacgtggacgacaaaattattaatcgtgcgcaagaagaaggcatttctgaactagaggttgctaataagtatgctgatgcctttgatgaagatactctgccattaaatattaaacctgccacggtgcgttcacgtgcaacagaagttatcccagagatcatcgaattcgtaaaagatcttattgataaaggctatgcatatgagtccgaaggggatgtttacttccgtgctaagaaattcaagggctatggtattttagctcatcaggatttggcagagatggaagctaatgctgctggtcgtttgaatgatgaggagactattcgtaaagaggatccgattgattttgctgtttggaaaaatgagccacgggaaggggttatctcatggtcgtctccatgggggaatggtcgtccgggctggcatatagagtgctcggttatggcgcaaaagtacttgtcgaatacaattgatatccatggtggcggtattgatttagcatttccacatcacacaaacgaaattgcgcagtctgaggccagaacgggacaaaagtttgttaattattggatgcataatggatttgttaatgttaataatgaaaagatgtcaaaatctctcggtaattttacaacgctacatgacatgctagcgacttatgacgatccaatggtcattcgatacttattgaccacaacgcagtatcggcgaccaattaactatgaagcaagcactttagaacaagcacgtttagaattagaacgcatccgtacagcttatagaaatttgatgtttcgagcggaaacatcggaacctggtggggatgaagatgttgagacattgattgaagtgcaaaagaaagcgtttgaccaggcgatggatgatgactttaatacgcccaacgcgcttgcagctatttttgaacttgttagtatagggaatacctacactgagcgtaacactgtaaaagttgatactgttcagcatttattaggaacaattgccgatttattatctgtatttggtattgagggattggatggtaacgaagaacttacaacgaagcaacgcgaattattggataaacgtgtattagctcgtgagtcgcatgattttgaagaatcagacttgttacgtaatcagttaaaagaagttggtatatttgtagaagatacaccacaaggccaacgttggcataaataaaaaaagctatcagcttgctgatggctttttttatttacttaaaccaaaattagcattggcataatcattggtttgcgagctgtttctttgaataagattttggggtactggtacataaggttttcagatacccttgtagtaaaactgtagtaaatattgaaaattacagcaaattaagaagcgtgatggtgtgtgatatttccttatttcgcttcacttgtaagaggtgtaaatatgtcttttgggtgatagaaatatctttgtgacccaatcgttcactgatatattctacagctaccccttgagaaatcaacatagaagcatggctgtgtcttaatccgtggaaagttattcttttggggatgtctaatcttgttaatattctttgcaattcacgattcacactggattgctgacgattaaataatctttcgttattgcctttagataaagtaagtagataatctgttaaccattctggaacatctacgcacctgattgaactagtggttttaggctcctttacaatattcagacgttcctcataagatttgttgatgttgattgtcccgtttccgacatctttaggtgtaagggctaatacttctcccaatcttgcacccgataaagaagctactaacataatatcgtgagttggttcatgattttcttttagatattctataaagcgtttgaagtcagcgtactctagaaactttagcgagctgtccttagcattagtaccgtgcggttttgctctttcaaaagggttaacccttattattccatcagctacggcatccttcaatattccacttagatgtcctttgactttttggctagtagcaagagagtgggagagaccgtagttgtttaaaaacttttgtgcatcatgacgggttacttgatctatcgaagtgttttcaaagtattcgctaacagctttcaaagtcatttcataaccaacgtgcgttgaacgtgatacgtctgttttatatgtatcaatccattcatttacataggaagaaagaagttgtgacggtttaaagtcaatatcgccatcaattttagatccttcagtttttatagcccattggtttgcttcagtttttgttttgaagcctgatttggttttcttcttgtatccgccttgatagggtacggatacactgacggtaaatgttttacctcttttgtatattgaagccatagtacagtatccttaaaataattattgtgaataatagtgagaaatagtgaactttatttgtcaataaatcattacagtgatataatattatgtgaaggaacgttgatagagtatcttttagttccttttgtaacctgtgcatgttagaacggcaacatgtccctgccgatggggcaaatcatcggaggatatcccggcagtgatgacctactgctcgccgtagtacatatatttaattaaccggcatatgccggtttttttatggagtgataatggaacttgacgaaatattgagcgactacacaattaaatttaatggaagagcgcttgaattatacaccgactgcaaggaatatctaaatattaaaatagtattttcaagcactgcgattccccatttactcggattagataaaatgattagcgtacctaccactagaccaaagaaacttaacaagctaatcaaagataagaaatataccattgatatggtaaaaagagacgtagcctacggtgatattaaaagtcgaattgataactactcattcattgagaaagtatttactaactaccagtattgctcgtttattcctaataaaaccgatccgcacaggttaggaaaagttgaagttgtgttatcagaaaatttatctaataaagagatggttatacttggattagttgcgacttctcaaggctacttcactccagctactcttcacgtcagaaacattccaaattcattttcaacaattaaaagatataaaattaaaaatgtggtttggcttcaataaaaaccttctttaaaaagggggcttatatctgttataatctaatggaacgccccgtgcgtttgcagtatactttcagcacacccagtctttagccagtagggtgttttttttatttgcttattttagagacttcattgtctattatgtacgcccattagggcattttttatttcaaaccagttgatacagcagagtacaacaagtaagaaccatcatcttgcttcatgaatgacaaagtaacattcgatgtaaagtcaccatttgtatttgtccatgtgctagttctagtattcatatcattgactgaagaatcagtagatgttgatggtttaccatatttactgatgacgtcattcatgtttgctccgccagcaccgttattcattatgtcgccttttgctagtgaatcataatctgattgtgtccattcttgaacagaggcactagaagaactgctttgtgacgaagcagaacttaaactttttgcagtggtcgaattggaagaactatcggaagaagtacttttgtttcctccgcccagagatcctcctataattatcaagaccactatagcgagagcccaaaaccaaacacgcttataaatcggctttttttgcacataggttttcccattatcaccaactatttttttgctcatctcttaatctccaaaaccttttaatgtggttgcttagcacatatatgtacaccgcaaagcggtttataatacgacgacaccgaagatagaactttcgtggttctcatcgataggcatgtcatcgtattttttgtttaatgaaacaaatcgtgaaccagattcatcgctaacatatttcttaacgaaagcttgttgatcgtagtcagcaataacaatctgacctgaacgaacctctgttgttttcttgacgaatatgatttgcttatcatcgaataatggaagcattgaatcaccatttaccacaacggcgaagtcgtgaacaggaacatcaccatcatactcaacgagttctggttttccatctaataagtattcacctgtaccagctgatacagctccgtaaacgctaacttgtcttttttcagaaatagggaaagcaactacgttattttgttcatctaattgtttgcgtgcgtagtcgactacattgtttttgcggttggtatcaagttgattatatattgaaacgatatcgtcatcttgtgacagtcccagaatatattcgggggttacacctaaagctgaggcaaactcattgacacgattcaaagggaattcacgtgtcctgttaaagtatcttgaaacagcagattttgccatgtctactcgacgtgccaattcgctgatggaataacctctattatcagttagttccttaattaggttgactatttcatcattagtgcgcatctacatttctccataaaagtgtttttttacattataccaccgttcccataagtatacaaacaaaacccaaaaaagaacaaaaactattttcatttgcacaaagtgttgacatacgagaacgatagttgtatattaatagtgtacccgaaagagaacgaaaggaggagacgagatgaatgtaaatttaaaaaggttaaaagctgagagaatagcgaacgggttaactcaagatgaaatggctaatcgtatgggctggaaatcaagaacgccatacgccaaacgagagttaggattaattccaatcggcgctgacgaattagcaagagcggcagaaattttagggtatgatacaaattcgttaggtattttttttactctaagtgttctcaaaaaagaacgacaacaaccagcatagaaaggaagtggaaacatggaagaaaaacaagaaattttggaattaaaaaaagaagtcagcgagttaaaaacacaagtggcttctctacaaacaagtaacgcaactattacgcaactgtttttgaaatttaaagcaaataccgaagcaatgatttcggtaatgaagacagacatcttactcaaaaagtagagttccgccctcaacttcggaataagtgacggtgtatccttgcttttctgcttcagcagtcatctcttcacgagataacgtaaagtcggaaattctaacaccggtcttatctcctggttttcttatagtgtttttcaaaacggaatccagattatcccatccgtattgaggtccaccgtcataaggctttggtgataatcccattttagttttctcctttcctaaactaggcaaatgagccagtaactaaaggatagcactacaaacacattaaaacattagaaagaaggtgatcatatggtaacgcagctacttgcaaaactggatgaaatcataaggtttttccacaagagccaattaccagaagtcatggataaaacagagttggctcagtttctgggagttggcataaacagcgttaataactatatctattcagatgggtttccttatatagaacaaccaaatatgaagaacggttatccgaaaaaggcagtccaagaatggatagataagaatactaaattttacggaaggtaaacagtatggaagaaattatcaagattaatcaaaacgaacaaggggaagcgcaagtaagtgctcgtgatttacatgaagcactgaatgttaaagcgcgtttcaatgactggattactagaatgattgaatatggtttttcagaaggcgtggacttttactcatttttgagtaaaacctcaaacggtggtcgcccaagcgttgaatacaatttaacgattagtacagcaaaagaaattgcgatgctacagcgtaacgaaaaaggtaagcaggttcgtaattacttcattcaagtcgaagaacgctataagcaattagcaagtgatccatcttatcaaatggcactcggtttgaaagcatcacaacagctacttgaacataaggacaagattattgctgaaatgaaacccaaagcattgttcgctgatgcagtgagtgcaagtcaaaccagcatcttggttggtgaactagcaaagctactgaaacagaacggcattgatacaggtgctaaccgattatttacttggttgcgtgataatggttatctaattcgacgtaagggaacagattacaacatgccaactcaaaagagcatggaaatgggattgtttgaaataaaggaacataaccacatcaactcaaatggtgtaaacgtaacgactaaaacaccaaaggtaactggtaagggacagcaatactttattaataagtttttgcaggcagcataggagaaaaaacatggaaaatccaaaaattaaccccttaaaacgtttcgaaaaatttgagggttacaaaataagtttagaagtgttaaacaacgaaaaaaagccaccggttaaggaagcttggattgaatattttgagagcgatggtactctggttggaattattcgcccagattagagcttggattaatacgttggctgtcactgacaatttgtgctaatgcttcctcgtcttcatggacttctatataccatttcttgatgatgaattctattatttttgtcgcatgcaaggcctcatcctgagtgacgttttcggctatttctttaggatgtgcaccgatattgccaagatcgcggagggcatgcaaggccttcttcacaggagatgctacttcattatctaacaaattgatttcgttataaagatttcccttctgaatgtttggaaacttatcctgaataaaaccctgaagcgctcgtctagaaagtgttaatgaagcacgcggtgatgcttcagcaattaatactgcctcataatagtcttgggctggttcctgtggaacgaaaccaggaacaatacttgcatttgaaactggtttgatattaaatttaacgttttgcccctctttttccgttatgagataaacaaatatcgttgtttcaaagcaggtagcgcattcaacgaaatgcacttctaagtacgggaaagttttggtattcaagcccaatgacaattcaatgctattatcaaacgttccttttctagagttataaaaactaacatggttgttgttgccggctaaaggaatagttactccacaatatttgcaaactatggttgtgctattgaatcgactaattgtttcggcatttgttagaggttgtggcatattgtcttccttacgttttatggttttatattaaagattataacattctcatgaatatcaaaacaataatttatgaaaagtattagaaaagaagtcagcatgtcaaagagtgcagattcagaagacattaggcagtcgttgcttgattacgcacaggcagcaatcagcaaaggtcaagaggcggtagcagttgaattagcatcagattcatcagaagactatttagttgctgaattagataccacggcatatgaacttggagagttgattaataacttgcgtcagattaacaaaggagcaacggtacacgaatatataagaggagaaatataatgtggtttttacaaataatagcagtagcaatcattctagccctagttttcgtaggcggcatgatacaaggcgagtcacaagagcgtgagcatcaacggaataaacatcgtttggaacgtatgggtggcacagatggtagcaacaagtacatgcgtgtcaaataaaaaagcgcctaactgctggaacagttaaagcgcaaagatataaattattgtcaaagaaaatttatatctcgattatagcaagaaacgaggtaaatgcaaatggtacaagatgcgttagctcattatcagccagatgttgaaagttcagcatggcggaaaaagcagagcagaattgaatacttatgcaaagaacgtgatgcagcattggacgaaattcaaggttgccaagattacgtagaagaactcgaacaagaattaacacagttagaatcaggagattaattatggcaaatgaagtagcacaacgtcaaaaaatcattaacagtgacaagatgcaaaagcattttgaggaaatattgaaagacaacgcagccggtttcttaagtggattgtcaacggtagtggcattaaacccagacttagcaaaaacaaatatgaatgacctgactaacgctgcaatgcgagcggccattcttgatttatctgtcttaccagaccttggcgaagcctacgttattccgtatggaaagcgagcaaaagtagatggtaagtgggtaaccaaagatgttaaagcccaattccaactagggtatcgagggattatcaagcttgtacaaaacaccggtcgtgttggtcgtttgggcggaagtgttgtttatgaagcgaataagccacattacaactatgtatttgatgaattcacaatggaaaatgaaaattatgatccatacgtagatggtgaaagcccagtagccggataccttgcattttattacttagatggtgaacgcattgttaaatattggccaatccaacgagtaattaatcatgctatgaagttcagccaaacttataaggggccagatcacaaagaccgttacgggaaaacaccacagacgccatggtacacggactttgatgcaatggcgattaaaactgtgatgaaagaccttcttaagtttgctcccaagacaaccaaggttgcgcaagctattgcagaagatgacaagaacgaacgtgaagcacgtgatgttactccagaaacagaagaaatcactactactgacgatcaaaacgttgaaccagaaattattgataatcaaccagaagaaaaaagtgacaatccatttgctggagtcgatacaggtgatgcaccaaatccatttgctgaaaagaatgagacttcggaggacgtgaaatgagtgaaccaaagacagtaatgccgttaattagctttgaaaacggtgtggcacaggactggaacgatttacgagcaacgttgaacggtgttgaagtgaccacgattagtagcaaggtagatgcacaaagcatggcttctttgaagaaagacatgaagcaagtatctgacttaatcaagaaatcagtgaagcaaaatgttaaggaatatgaacaagaattaacagagcgcaatggcggtttattcgccgtgaaggataccgctgattcaatcattgaggatatcacggaagaacaaaacacgtggaacgttggccgtctaaagcaattacaaccagtgttgcaaaaagaaattgatgaacgtaatgaatcgtatcaacttaaaacaccattgaccattaaggctgactggttaaagattagcaatttcactgctaccggtaaaccaactggagcgctaacaaagttattgaatctagagtttgttcaagccaaagcattggagtctgaaccacctaagttgacagaagttcaggaagtgaaaaaagcgattaaatatgagttctcgaaactttgggacgatattcaagatgacgatatctacaccggtaaagacttcaaacagatgctttctgaaatcgccaagcaattaaattaaggtcgttatgacccgatcatcgtcactaaactgattagccagtgaaaagagtttaagtcgctcgattcgttgatgttcattcgtatgatggcgatgtggcgtaaccacacgaaagggtgtgaagcccaaaggagaaacatggcacaaagaagaatgtttagtaaaaaagttaccgacacagatacttttcttgatatgccgttgtcaacacaggcgctatattttcacttaaatatgcatgcagatgatgacggatttatagataataccaaaacaattcaaagaatgattgggtctagcgatgacgatagaaagttgttaatcgcaaaacagtttctattaccatttgaaaatgggttagtagttataaaagattggcgagttcataactatatacaaggcgataggtatcacaaaacccagtatatcaacgaaagaagccaacttgttgttgaagaaaataatatgtatacaaaacgtatacaagatgtatccaacatggatacgcaggtaaggttaggtaaggataggttaggtaaggatagaaaagatatattgtccggttccgaagaacctgaccaactcccttacaaagaagttgttgattatttgaacgaaaacactggtagtaagtatcgaagtagtggaactaaaactaaaaatttaatcaaagcaagatttaacgaagggtttagtttagatgatttcagaactgtgattgatgttaaaagcaagcaatggttaacagatcaaaaaatgaaacagtacctaagacctgaaacattgtttggaactaagtttgaaagttacttgaatgaaaacgaggtaactagcaaaccagcaatgaagaacggaggctatggaacaagatgaatagcctcaaggagatgttggaaaacgatgaacgctttgccaagaacaaggttagcgatgaagaattgcaagcatggcgtgaaaaagtagaacgtgaagaccaggaacgagttcgtcaagcactgtttaataacagggcacgtatctacaagcgagatagcgtgtggggaactagcggtgagcagacgttcacatttcagaagtggaacccaaaagtgcaacctaatcaaaagttagcccatgacatttggaaaaagtcagcagatatcactaagagaatgtttgatagtaatttcaacgttctgttctacggtgaagctggtactggtaaaacagccatggtgttagcaatcattgatgcactgaaacagcactcagataagttgagtatgtttgtcagcgttatggacttacgagaattgattatgtatgacttcaacgacaatgaagcagctatcaagataaagaacattgagcgatcaatgcgtgaagttgatgtgttgatacttgatgactttggttctgaagctggtggtatgaaaaacgaaggtagtgccactgaaagattacagcaattctggtttcgagttgctgaagcaaggcaagtgaaagacaaggacggcaacaagcgttacagcactatcgtaaccacaaacaacgataggggcgatttggaacgcatgtacaacaagaagattgttagccgactgattacaaaaaaagcagagaacacggttgtgtttgacggattggacgatgtcagagaatgagttatcaaatgatttgtacagaaaacgacagagtgattatgcgagacccaagagtgttcacgaagtttgatgatgtggagtacgcattagcaaagcgcatgtgcgttgacagtgaaccttggaattggggcattgaaatagtgtaggagtgcttagtgaccgaattatttggacaagtaaataagctagatccaaacaaagggttagtcacattgcaaatgagtgatgatgatttgcgcacattgcagaagtatcacgcaaccaatcagaaacaagttctatcggtggtagctagtgatgataatgagccgacaccaaaacagcgtagatttgcgtttgcactgctcaatgacatttggttgtcacaagtaggtggagcatggttagagactgtagaaagcacgagaaggcacttttacggtatgtacgagtattaccatggtttagactttggtgagtttagcctgagcgcaatcaagggcaacaagtcggatacaaatgagttcatcaacatgttattagattacgcagttttgcataacatcagcttgagtgtgaagccgttgaatgaactggagccacaggaaatagcgcactgggaatatcagtgtctgatgaacaagtgttgcgtgatatgtggcaagagaccgagtgacctgcaccatttagacacgattggtcaaggggtagacaggcgcaagactaaccatttgaaacacatagccgtgcaattatgtcgtattcatcatcaggacgcgcattcgttaggtattgagacattcttacagaaacaccacctgacaggcatcaagatagatgagcgaattgcagaggttcatagattaaacattagataggcagtaataaatgttttaaggcgttaaacactgtttaggtataaatacactaaaccgaatttaaaacgtcaaattggactgtttatgtgggtttgagagcgaacgagaggtatagagatggcaacaagtaaaagactaagtccatttgaagaagcaaggcaagcatttttaactccagatggcgaaccacgaggtgtggttgatggtcgatatgcattggaagtaattagcaaattggaaagacgtataaaaaatcataatgaattaattattatgcagagggcaagccgataaatgtttaaatttgagacagaattaacagttaatccagcacctcataatcaatcaaattttaataagtttggaaaagtttacaagagcaagcaagaaaaagcttacattgcggatttggcgattaggttgaagtctaaattgaatcgtagtaagttcaaaagatttggcccgcaaccgatacgtgttgattacgtgttcggtttcatgccaccgcggtcgtggagcaagaagaaaaaattatcagcgcttaatcatgagatatacccaacatcatcacagctaggtgattgggataacttatgcaagtcaacacaagacagattgaatgcgctgattattgaagatgatcgtttcattgtagatggccgagggcggaagatttacaccgaaaaaccttatttgaagattgaaatagaggaggttaagcaatgacaaactatgcgacaggattttgcatcgtggaaaggtcacgaggatttgaagaggcttgcacatggatgcagaaaaagttaaaacctgaaacagcaggaagggaggaaagtgaccgtttttggagtgagatcaaaacccaagctttaataactatgttaagtgacggttatggaattgatgaaatatccgccacattaggtaagacgatacaacaaatatacgctaaaagaagattgttagccagcaatggggtagtaagtaagcctgttccaccatcggagataaaaaaacagcgcaagggtaaatttattgagttggttgaacaaggtgaaaataacgttaaattaatcgccgataaaataggttgctccactacagctgtctatgagtatgccaaagaaacctgctacgaaataaagagtgggagagtaataatatgacgatcgaagaatacaacaagtctgttcaagacagacataataaacaagcggtatctgacggacgtttcaccgactcatttgaacgcaggtcagcggtacaacggcacaaaatggcacaacggaaacaacgagttcggttgctaatacaagaaggcatcaccagtattgatgttctagcgcaacatttcactattagcgtatcaacaatgcgtggcgttatctatcaaatgggattaaggattgaaaatagtcgggtggttgtatgacgatatacaaaataacggctgtaccgtcacatttcatggagctgtttaactcatactacgattatgaataccaaaacggcgagtatgtgtcagataaacactatgaggcactaaaagcagaagtagagcatttcaacagcaacgtatcgaaagctgtgactataaaaatagagaaagtgtgatgagatgaaattcaccagcgaaaaagttaatgaattgcttggtgttgatgaagcattcaaagttccaaacaagttaatgtcaatcatgatgaatcgtgaacaacgtgagcaaacgtttaaagcatttttggaagttgagcgcgatacatcgtttgattggtttcacgaatattttgaaagtgaacagtccgagcgcaagactaagaagcaagatttcacgccaaacagtgtttctgacattatgacgaaacttgttgggaaagcagatacctattttgaatcagcagctggtacaggtggtattgctatccgtcattggtggcatgatttgattgataaccacaacccatttttctatgaaccgtcagatgattatatggtactagaggaacagtcagagcgtgcgttaccgtttctgttattcaatttatcaataaggggtatcaacgcaatcgttattcatggtgatagtttaagccgtgaagtcaacaatgtttattatctactgaatgataaaaatgatttcttagcatttagcacagtaaatgttatgccacaaaataaaaccacaatgagtgagtttaatgtttatcgatatattgatgagccgatagatcacattgaagcagacatcaatatgtggcgtgacaatgttggtaataagtacgattttgcagctaagtttattgaaaagtattcaaaattaaaaggagttagtcatgaaaatagttagcttacagagcgtggaattggttgatgacatcggcaatgatattcatgagtttttacacggaggagataagtgatgactgaaccagtagcatatatgtggaaaacagtacaaggaacaataattgcacttgcaccaaatgacaatagccattcaggcggacgacttgggataccgctttacacagcagagcagttacacccacgtgtgaagatgacgcaggcggaatttgacgagtggaaagagctttattatcgtttgaatgaattttctttcaatgttcatagaatgttagatgagatattaggtagcataggtgtagaacgtggaatatataccaagttagcaaaacgtgtatatcaagatgatgatttcatggctatttctaaaaaacaatctgaattaattaatttgtttatcaattatagtccagacaacccagaagaaacgattgagattgttcctgatatgaagtggtttgtgagaagtaaaaaagtagtaaaagtagtaggcgaaaacaattattacgcatggctatttgataatgattatttagacgtaccagagtgcatgattagtgatgtaatcccaccattagcaatgatatttgacaccaaagaagaagcggaaaaatggactaacccactaacagaagcggtgcagttaccagtggaggaaaacaatgattgaaagcgttagaaaaccaacagctgttgaatgcgtgtggcaacgacaggacgaagctaaaaagatgttcattgaccatgacacatttgccgaggttgaacgtttagatattaaagtattaaccaatattgcaaaagaagagggaacaacgcttgaaaagttcttgatttatgcacgacatagaagcggtgacaaatgattgaaatagggcacaacttacagcatgcgattgagtttggaacgttattgtcagcaatggtcgcagttacttatattgtattgaaatattatggagagagaaaatgacatttgatgaagcgttgaatgaattagaaccaagaacaatttggagcagtgaaatgcgtgacttattagaacagttacgacaagaatatgcgccaactgttgagatgactaaagaacagcgtaagggactattgtttgatgggaaagggcgcgaaacacctcataaaaattttgtttttatgaaagaagtacaaaaggttaacgaaaagaatattaatattgatattttaatgagtgcgtttgtacacccagaaacaatcaagatagttgacgaataggtaaaggagcaaggtgtgactcaactcaataatgatttataaagacaagtatcaatatctgtatcgttataccaaaaatagaaattacttttgtgccacggctatgtattaaaaagccgattagaagagtgatcagcaatagaataatcataaagtgaattaaagcgtgaagtagtaataaagtcataatgccccctaacgtttttaatattataacatgtagaaagaggagagaaaattggcggatagagtagatagcattttgagagactacttctctggtcgtctcgaattaagaattaaacagcgtatagaaacgatacggtatgacagtcaagaagttgatgagaatataggtggcggtcgtgcgcagaacaaacacacacgcccagttgatgacatggtgatacgtattgagcaggatagataccttaacagtctcaaaaagcaaaaggaagacgttgagcgctggatagccacgtttgagccagacaagcagaaagtagtttcgtattattatgcaagcaagtctgtcacatgggttaaggtggcgcagcagtttcacatatcagaaagaacagcaatcgcttggcgcacagaagtcaaacacatattaggcgcagtcctataacactgcggtttttatgcagttttatgcataaatataggattatattgttaatatcagataatttgaaacagggttattgctaatccattaaaagcaacgttgcacacacttcggaaaaagaattagtggtaatgtaaaatagataggttgaaatatctatcattatgacaggtcgcggaacagaccgctccagtaccttacatgagcaactgggttagaaatatcgtttgtaaggtgcaaatccttaccctgtcaatactccttttaggagataacagttttcaccatagtcgccaaagtctttaaagtgacttccatagtgcgactttatactagttaggtgatttctgtgggtgaatgtaacacagatccgttttggctcgggtgaaaaagttggttcgaatccaaccattcactttaccggttatttaaaatattggtataatcttctatagttttaaaaacttaggagacggtgatggaagagtggaaaattgttaaatggttagctgaaaatttatcagctaccaatgtattgttgtctataatagtattagttttgattgcttacttgactaagtcacctgattggttgagagataaatttcaaaaaagaaatgcgcaagtactgcaaatagaacaattttatagacaaaattctggtgaagatttgaaaaacattcaaaatgaatggttgacaatatttaatactatgggtaaaaattttactgaatctaaagcacaaggtttgattacaagaactattgctgttgcatctggtaaaacaactgttattttgacatccatgcttcaacatatttatcaagaagacgaaacagatgatacctatatactcatggtttattttgctgaagtagttgattctttgaaaaaagattttacaggagaaaatatgggcgcatttattttaattcagtctaaaataaatgactttcaaaaggaattacctaagtataaagaagcttataaaatatataagagagaagttaaaagaacaaagagaggaataaagatgccattaacgataaaacttataattatagctgcggtactatttattattctggctctagttgtttattttataaataaaatgtagtaataacagtcacttgcattgattgtatacataaaaatacacggtccaatttgcgaatctaaaacagatacgcaggttggactttttgtttggagaaaactatgaaaatagatgacgagtatggacttgtcgccagtgatgatgaattaaacatctaccgcaaaattgacaaacaaagacaatacagcaggaaacaaaacaaagcatctaaacgcagacatcacacagacaagcgcaaagatgctttttacgaagataggaagtggcagtgatgattcgtttgaattggactgatgaacaaaagaatagaatcatcgaattaagcaaacaaggtttatcgtcgcctaaagttgcgcaacagatgttcgatgaatatggcattaactttagcaaacgtacggttgcaaggtttatcgcaacaggccataccagtagccattataaaggcaaaccaaaatctaaagttaaagatgtgaagcgtggtactgaaattgtcatcaataaagacggtagcacaacatcaacaaccaccattgaaaacatgaatcgtgaaaaagcaaaggacgttgactttgtcttgcgagcacatggctttgatccagaagactgggatattgtctctgctaaaagtaatttctggcaacagaatagtgttgaaaaaggtttgattgacctatgccaatctaagattacggttaagcctaagtcagatgatgaattaacgccacaagatattgctaagctgtttaaagcagatattaagacatacacagttaagcaggttgcacgagatacgcacaatttggttgtaccgcttcctgatttgcattttggtataactaccatgcttgatgttaaaggtcacctagacagtctgttagagcttatcagtaagggctataaaacgattgtgattgaacagttgggtgatctattccattctagtcagatgtggtcatcacagactttaaaaggcacgttacttgatgaagttaatatggtgcaagccgttgaggacgctaagcagttctttgatgtattggtcactgctgcattgcaaaatagtacaacacttcacatcaaacaaatggctggcaatcatagtgctaatttggagtacatgttcatggagtatttgaaagccaaatacccacaagtcgttatcaagaacaatattaaatttcgtgacgcttatttactggataacgtcggtatcatgttggctcacggtgacttagcacctaagaacttgccaatgctatttgctaatgagtttggtggtgtctggtcactatcgcacagtcgtgaaatccacaagggccactttcacaaggaaaagacagttgatgagggtggcgtgattagtcgacaacttggaacggttaaacctaatgacaagtatgaaattatgaacggttggacgttatccaagaaagaactatatgcacttgaatatgatagcgacaagttagttgccgagtggcacgtttaggagaatgatatgttaaacaagcttagtctcattttgctgtcgctattgactttgataaatttatgtttggggatacaaaatactaacatatatcgaacaaatagatcgaacaacgaaaaacactcaaaatattctgattacgatggcattaattcaaaacaaaaactttttaattatgttaacaaaatgtacaccgacaaaggaattaaagtcaccgagaatgagggcaacggtatttcaattaacattgataccgatattttagacaaaaaatactttgattcaataaacaacttccctaagatgaataagcatgagattgaaacattgagctacaacagtgattcagatatatcgatatggatagacggtaatttgtcgtatgatgtttcccgaggacatttaacacactttacctttggtagatttatcagttggacatgagcgcataagcgctttttattttgcacaaaaacattgaaaggaggtgccttaaatgacatgaaactaacaccgaaacaaaagaagtttgctgatgagtatatcaagactggaaacgctacacagtcagcgattgaagcgggttatagtaagcggactgctgcggttattgcgacggaaaacctaataaaacctaatataaaagcatacatagaaaagtgcatggctgaaatagcttcaaaccgtgttatgagctatacagaagccgttgaactgctgactagtatagctagaggtgaagaaaaagaaacggtcgttgtggcaactcctgtgagtgttgaaaaagtcgagaaagaagcagatttaaagacaagaattagtgctttgaaagagatacttaaacgttatccaaataatgacaaactcattgagcaacagatacgcaagttgagcgctgaagcagacattgcacaaaagaaagccgaactgttatccggaagtaatggtgatatatcaatcaacatacaaccatttgaggaggatgtttaatgcctacaatcaattggaatctacctaaaatggttagtaaagcttacgcaccactgttcaatagtaaagcacggtatatagcatataaaggcagccgtggtagcggtaagagtgagggagtagccactaaagttattcttgatattgttaccaaaccatacgtcaactggcttgttttgagacgatacgcaaatactaatagacaatcaacattcacattattacaaaaggttgctaatcgcatgggcgttggtagcctttttcaattcaacggttcgctacctgaaataacgtataagccaacagggcaaaagatattgttccgtggtgcagataaaccattgtctatcacatcaatatctgttgagaccggtaacttatgtcgcctatgggtggaagaagcctatcaaatggagttggaagaatcatttgaaacggttgatgaatctatgcgtggtgtgattaatgatccggacggtttttatcaaacagtgttgacgtttaatccctggaacgaacgccattggttgaaacctaaattctttgatgaagatactagtgttgataattcattggccataacaaccacttacaaagacaatccgtttcttgatgaagattacgtcaatcgccttttagagatgaaagagcgtaatccaagacgtgcaagagttgctgttgatggcgagtggggcgttgcagagggtctgatatatgaaaacaccgttgttgagaagtttgatgttagagaagttgttaaagacgctcgtattgtacgtggaatggattggggatatggaccagacccgacagcgtttatcgaatacgcaatcaataacaggacaaaagatgtttatatctacaaagaaatgtataagcaacacatgctaactgatgaaatatttagatggctttatgttcatggctatcagcaaggagatattagggctgattatgctaacggtggcgaccgcatgatacaagaattgaagaacaaaggaatatcaggtatgaagcgtgcgcacaagtacgaaatcatgtttggtgttacctatttacaagacttcaaaatacatgtgttaccggcgcttgaacacaccatagaagaacttaactcgtatgtttatgatactgacaaagaaggcggttgggttggtaaggctgtcgataaaaacaaccacttgatggacgctatgagatatgcagcagagccgctaattatgactagaaagagcactactgaccgtatggaagcatttaagcaattaggcttaggaaggtaattatgacgatagattttttaactaaaacaaggtttggaccgcaagcaaatgaagtgtttaaaatgtcggctaatgactttgaaaatattgttgacatgggttcgactggatttattgaaaaagtcaatgattacatcacgtcatttcaatctaggcagttaccacgcttgcaagagttgaagcgctattatttggctgacaacaacatcaaatatcgtgatactggacgagataaagaccgtgccgataatcgcattgctagtgattgggctaaatacatcacggtattcatgcaagggtatatgttgggtaatccaattacttatgatagcgagagcgaaaacttgcttgataagattaacgatttttcaaagcaaaacggtgctgattatcatgacggattgattgaaacagacttaagtatatacggacgtgcatacgagcttgtctattcagataccaacgcacaagagcgcattactaaacttgaaccagagcaaacgtttgtcgtttatgatgacacgattgctgctaattcattgttcggtgtacgcttttatcaaattagttatagtgacagcgatacgaacagctttgtggaagtctatacagcagacaagatatattactacaagtccgaatcgtctgaatttagcagcatgacatttgttgatgttgctgaccatgcttataatggtgtgccaatcaatgaatacaagaacaacgaggaacggctaggcgattttgagagcgtactagatggaattgatgcctatgacctatcacagtcagagctagctaactttcagcaagatatgaatgacgcctacttggtgttgattggtaatccagtaactggaacagcggagccagagtatcaattagacgctgatggtgaaccgctgattgatgattttggtaagccactattaacagcaaattctagcacatcggtgtttgaggatatgaaaaaagcccgaatgctgataatggataacaatagtgatccagacggaccgaatccaaatgctttctatttgaccaagacttacgattcaactggtgcagaagcgtacaaagagaggttagttgatgacattctacgcttcacgtttacaccagatactaacgaccagaactttgctggtacacagtctggtgaagctatgaagtacaagctcatgggtaatgataatctgcgtaagaccaaagagcgtttgatgacgcgtggcattatgcgtcgcttgcgtttgcttggtaatgtgtgggctatcaaaaacagcgtatcaacaacaggcaagcaagaaggattgtatgacttgattaacgacattcaagttaagttcacaccgaatgtgccgcaaaatgatgaagaacgtgtctcacagcttaaacagctatatggcgttattagtgatgagacgttattctcactacttgaaacgtttacaggtgttgacgctgatacagagatgaagcggttggctgatgaaaagcaacaagaggttgaaaactttcaagcgcaaacgggttactcacaattgaatgccaatgatggtggtgtaaatggctgataattattgggaaaagcgcacaaaggcaattatggacttgctagatgtcaaagatacagagttgactaatgccgtgctgaaagaatatcgtgctgcgtcagatgacatatcacgcaagatagatgatttctatgagaagtatgcagataagaatacaatctcgtatgacgaagcaagaaagcgtgtgagagctgttgaccttgacgactatgtgaaacgtgcaaatgcctatcgcaagtcaaacaagggcaatccagagctattaaagagattgaacgcacagtacatgacatctaagattagtcgattagaactgttgaagttagagattgattttaggatattgcaggcaagcaacgctcaatcagaaacatttaccgcatatctagctaaagaaggtgcatatatatacagttctttgtcggttggtaatgcgattaagacactgaatgaacgcgaaattgaatcaatcctacaaatggaatggagcggtgctagttattcacagcgaatatggcgtgataatgatgttttagctaacaagttgaaagatgagttagttaaagctgctattaacggcactaatccacgtgtcacggctaagaagttacgtgatgtatttggaggtactaaaccaaatacagagcggttggtccgcactgaatcaacctatgtggctaatgcttcaactgccaaacgatacgacaccatgggtgttaaagaatatgagtttgtggctgttatggataatagaacttcatcaatctgtcgtgagatgaacggccaaacattcccgttgagtgagtttatgccaggaacgaatgcaccagcaatgcaccctaactgtcgaagtacaatcgtaccagcagctagtgatctaactaaatacaataaatatctcgattcagacacggtagatgatttaccagacatggattgggatttttaaaaggagaattattatgaaaagatatcaaaagaaacctgtcgttattgaagctattcaatatgatgataagccagagacggatattgaattacaggaaaaatttggcattgaccccgttcgtgtgagttacaagaatccagatgaccctatccttattatcgaaacactggaaggggaaatgaaagcgcatgttggcgattatataatcaaaggcgtgcacggagaattatatccatgtaagccggatatttttgaagaaacatatgcaaaagccgattgaacactggcacaagtcggtgtttttattttgacctgaacacgtcgttaaatctattcaaaacaactaaagcggattagttggcggagatgagcgtgcttaaaggtgggctgtactgtaccaactgatgtacaaaggagaaacattactatgactgaaccagcagtagatccaaacgtaaatccagacccagctaaagagctaggtgctgatgataaggtaacaatgacaccagaagaatttgaagcagctaaacaagaggctgcggaaaaggaagcagaacgccgcgttgctaaagtgctttctaaaaagcaggcagagtggcaggaagctaaagacaaagagcttgaagaagctaagtcagaagccgctaagcttgccaagatgtcagccgaggaacgagctaaggcagaagcgaccaaacgtcaagatgagctagaaaagcgtgaaaaagcaatcaatttgcgtgagtaccgctatgaggctaaacaccaacttgaagaaaacggtctgccagatacgtttgttgacatggtgctatcagaagatgctgaaacaacaaaaaataatatcggtgccattaaagcagaatttgacaaggctattgaagcagctgtcaatgaaaggctaaaagggaaaacaccacaaactggtggtacagccggtaaattcaataaaaaactaggtgatatgtctttggaagaaatgacggaagcataccgcaataacactaatctattcggttaatatcaaggaggatataaaatatgccagtaacagatttatcaaatacaattatcccggtagtcttcgacaaatatgtgttgaacacaattctgaagacaaatcggttcattaaatcaggaattatcgttcctgaccaaacattgggagaccaattaatgcagcccggtgatgaaatcacaattccatttttgaatgatttgtcgggagaccctcaagcgtggactgatacagaggacattgatgtcgctaatcttactactggttcacagcgcgcaattaagttccgtcaggccaaagcgtttggttcaaccgaaatttctcgaatggtttcaggagcgccaattgccgaaaccattgccactcgatttgctaactattggaacaatgtcgatcaaactattttgaattcaacgcttaagggcgtatttctcaatgataaggtggccaacaccaagttgtttgaccaaacggttgtgtcaccatcaacacctacatttggtgctaaaggattcttggcagctattggattacttggcgatttgcaagaccaaacattcactaagattgccgttaattcagcaacatattcacagatgaaatacgagggaatgatttccaccattcaaccacaaggctcggtaacaccaattaattattacaacaatatggaagttattgttgatgatgatattcctttggaaactggtggtattgcaacggcttatatctatggttctggtgccgtttcatattcaactgtattgcattcaacggaggttgttcatgaaccattgaagcaaggtggacgcgattcagtggttaacaagcgtgtatcagcaactcacgttaatggtacaacgttggctaaatcatttaatccagccggtcaaacaactatcaaagacgaattagccaaaggtacaacttgggatattgctgatggcgtagacccacgtaatattcgtgttgtggcttacaagtcaaagcttgatgatgactttgttccagctgcatttaaaggtacacccagtcaaggctaataacctagctgatgaaacgccagctaaaccaactgacactaatacagtagctgaaattaaggcgtggttagaggcacataatgttgcttatccatctagcgctgtaaaagctgacttgttagcgttggtcaacgacacagacacttaatctgtcgaatgtggtgtgaagcccattaaggaggaactatggcagatgaaactaataatttaaccaaagtcaaactgcttgtgtcaatcacagataccgagcaagatgatttattaaatctgctgttggacgatagtgaagctcggttactaagctacatcaatcaggacggaaacaacgctacaacattccctaatgaggtatcgtggttattgcgcgaaatcacaatcagacgatttaaccgtatcggtgatgagggcaaaaagtcatctggtgaaagtgatgtgacggctacatggtctgatgatgatgtggctgattatgctgtttatttatccaagtatcgcaagaaaaagggtggtaatggcatagcgaggtttgtctgatgagatacaatgatcgcgttaaaatcattaccaatcagaaagctgacaatgacggttgggacgatgatgttaagccggttacctctgactggttgccgtgccgtattaccggagttggtgatgagctaaatatgggtgtattcggtaagtatgaatcaggcgctcgagagatttattttaaaaacaaagttccgaacatggactatgtactgatagatgagaatatcaagcgcaaaccaaaagctatcaatcaggcacgaaaaaatacggttgttattataggttcggtgtaatatggctaaatcgaaaatgacaatcacatttgacggtgctgacgctttgattaagaagtttaacagccaaccagctattatccagaaagaagctagtgacatcatcttgaacacggctaatcgtgtggaaacaagagccaagcagtttgcgccggttgacaccggatatttgaaacaacacattgcttctgaaaagacgggaatgttaagtgcagacgttacttcgagtgctgaatattctgtttatcaggaattcggcacacgtaagatggcgggtaagtcatttatgcgaccggctatggcgcaagagtcaccatttctattccaaaagcttcaaaacttgctgaaaggaggacttagatgacatcaccgatgaacacgttgctaaatagtattcgagacagtctaaaaacgggtgacattccagtcaagtcacgactacctgatgcaacagtacccgaaccattcattgtcattggtactcactttgatgatgatgcgccctctggtaagaatggttatgaggtgctaacaacagatttacaaattgatctattctactcaattgacagtaggacggcgctggaagaagcaatttacagcgcaaaatcacaaattaaacacgccacttcgagaatcacacgagtgacatcaaacacgattaccgatgattcggtaggaagagatgtctatcatgtgatttttattgtgacagcaattatttaaaggagatacatacatggcatacgtagataacggtgttgaaacaacaaaaggaaccccaacactaggcaagaagatttggtactttattcaatcaactagtgcagctgttggtgctaaagctattttaccggctgcacaaactgatggttcaacaagcattgagggcgattcgatcgatgaacaaactaaatttggacgcgttgttatgccttctactaatgaagattctatcgaattgtcaacttacgtagtaccgggcgataaggccattgacatcattaaagatgcaaagcacaacggacatcaagtcaaagtttggcgagtgaatgttgacaagcgattcgctgttgaagaagcagaagatagtgaccctgaaaagaagcatcaagcatttcctgcaatgtttgggtatggggttgttgatagtttggatattgacgatggtgatgacttggtaagtgctgactatactttgaacataatcggaaagttgacagacggaacgttcccgttatctgatgatcaattatctgcattagaggaattagcaaagtacgaacgaccaggtgaaactactggtgactttggttctgacgaacctgcacaataagagcttcggctctctacataaaaaataggagattaactcatggaagtaacaattggtaagaaaacatcaacattgaaatttaattttaaggcattatttaatgccaatcgtgactttagcaatacagatgacaagggtaataacttaggagatggtgctactaatctattcacacgtattttgatgggtgatacttctgttattccagacattatcaaagtagctggaaatattgataaagtttcagctgacgaattatttgctgctgttgatgaacttactgaagacggtaaaaagattgatgaaacgctagatgaattaaaggacgagttgaaaaatagcggttttttcaagaagtcaatcatcactcagaaagagaacatcgaggaagctcttccggcattgaagaaaaaggaacagacggaagaagtgaaagctcaggtagcggcggtcgaacgtattctgaaattgctgaacgaaaatctttaatcgaaacttgtgcaaggtttggaatattcgacattgagtgggtattgacactttataaatgggaactagatgcagtaattaaaggcgttcaaatggctaacattgatgaacgtgaaagactagcagtattagccgctaacatcggttatttcagtaacgccaagaaacctaaatttaaaaaagtatttgatcgtgccaaggaggagaaattactcgaaaaggcatacaagccagagcaggcagaagccgataagcagaagcgagttgcattgtacagcaaggtatctgctgcgtttaacggagaaaggagtgaaaatggcgacttataatggtggagaagttgttgctcacgttggagctgatatatcggattatcggtcagctatgaaatcactttctagttctactagcagtgcaatgagtagtacgagtcaggcgatatctagtattggtaaaacgctgactgttacaggggcagcgataacagctttgggtgtaaaaagtacgaatagttttggagactttcaagcttcattgaacaaagcggcggttatagcaggtggaacatcaaaagatatccaaggattagctgatgtggccaatcacatgggggctgttttgcctatcagtgctcaagatgctgcagacgctatggttgcaatggctcgtgatggtgcttcgcttgaaacaatcaaaaaagagttccctgcaatcgctgaagctgctactgctgccggtgctgatttacagacaacggctagtgttgtgcaacaatcaatgaacatatggggtgattctttagaaagtcctcaacaagcagctgctattttgacagaaacagctaacttatctaacgcatcaatcgaggatatgcagcaagcattggctactattggtggtactgcatctaacgctggaatcagcatgactgacacatctgaagcaatcggattgttaactaacaaaggtttcagtgctgcacaagcatcactggacttaaaccacgcattacttctcatgcaagctccatctgataaagcggcaaaacaagcggcagcattaggacttaatttcaatgatgcgcaaggtaatatgaaacctttgccacaaatattaaacgaaatatcggattcaatggacggcatgtcatcatctgacaaggcagcggcattaaaaacgatgtttggatcatctggtatggcagccatactacctttgatgaaatctattaaagataagactgacaacaccactaccagttgggacgcttatagcaaagcaatgcaagctgcatcaggagatactgcaacagccacagcgtttcttaacaatcaagctaatgaaatgcaaaagaatcttggatctaagattgaacaagtaggtggtaattgggaagcgctaagaaacgctgcaatggctggaagtgctggtgtcatttctagtattgttgacatgatgagtagcacactggaatgggctacaacatctaatagcgctataggaagtgggataagaacgttcttgggattatctccaattataggtgcagcgactctggcaacggggtcgtttttaactgcagcaaccaaaataggcagtgtcatgagtacagttggtacagctttgaaaggtttgtttattagtccgcttggaatagcagttctggcaatagctgcattagtagctgctttcgcctacgcctataatactagcgaacagtttagaaagactatccaaaacttagctaattcatttaaaacggcattagcaccggcgattaactttattaaaaatacggtcatgtcatttgtagacaccgctatttctggattcaaaagctttgcggataatgctattgggtcattttctaaggtaacaaccggaataaactttagcgaactttcagatacagtcgttattgttttcagcgctcttatggatattgttatagcgtttggcaatgttgttacagatgttattgccgttataagtaatactggatcaattaaatcgtcttggatatctgttagttctgttttatcagctgtagaaatcgttgttggagttgttagagattcggtagtttctttaatcactggatttttgtcaacgggagccatacaatcagcttggaatgcagtaacggctgtaattggagctgttatttcaattgtttctgcattgtggtctgttattcaatctacaatacaatcatttggaggtgttggaacagctggtcaagtatttgtaaatgttggtcaatttatcggtaatgtggtaacaatcataggaactgttataacagcagtggctaatttcatttctgctgccatgaaaatacaagcagtcagagatattattcaagctgttattgtaacggctggtgctctattggttgcattcaaggcttattcaattgtcgtggccatcataacaagcattaagtcagctattgaaacagcaagaattgcaatgatgctattcaatgcagctcttgttgccaatccaataggattagtaattactgctgttgtcgctttagtagctggtctggtttatttctttacaatgactaaaaccggtcaagcgttgtgggctggatttgtatcgtttttacagtcatcattagctaacttagtatcaatatttcaagatatttggaatacaatgctgattgttgtgcaaacggttatattaggcatacaaatggcttgggttggattaggtgtgttacttggtgcactatggcagggaattgtaattgtatttagcacgatatggaatgggatggttgccgtagttacagctatcattaatggaatagtagcagcttggaactttttagcgccttatctatctgcgttctggcaagcaaacgtcattttgtttactacaatatggaatgtcttggtaacagtaatcacgataatcgttaataccattgtggctatttggaacggatttgttggcgttataacagcgatttggacgtcaatatcaaccatagctagtgctgtttggaatataatactaacagtgatcactactttggttactacaaccgtttctgtagtatcttcagtatggaatggaataataggtgttgtttctggaatatggaacgtggtttcatcagttgtatcaaatgtctggaatgtaattgttagtatagtaggcagtatggcaagtaatgcactaaatgtgcttcaatctatatggtccgccatatcaggagttgtttcatctatttggaattcagctaaaggaataatttctggaatatggagcgctatagtaggtgttgtttcgtctatggcaagcaatgcctttaatgcattacgaagtgcatggagtggtatatcaggatttgtcagtggattatggaattcggcaagaagtgctatatctggagcatggagtggcatagtatcgacaattagcagcatggcaagtaatgcttttggaagtttacgtggtgcttggggcggtgtagtaggttgggtttctggaatatggaacagtgttaaaggagcaattatgggggcgatgaactttagtttgttcggagctggtagcgcaatcatgaacggattcttaaacggtttgaaatctgtttggggagctataacttctttcgttggtggtattgcaagttggatcaaagcccacaagggaccaattagttacgataaaaagttacttattccagctggtactgcaatcatgggtggatttggtagttctttgaattcgagctttgctgatgttaaaaagtctgtttcatcttacgcaggacaaatagccgatgagtttggtcaacaaaagtacgttgctagcgctcaattaacaacaagcagtacgggcgttgccgggcaaataaacggcggattgtcagcattgagtgatgaggttgctgaacaaactgctcaacaaccggtatttgaagttcataacgaaatagttggtgacaaaattaccacaacagtcaatagcaacaatgcacgtagacaagcaacaacaagattagtcacaggaggtatttaatggatttattaattacaaatggcacatcaagcgctaaattaagtgataaaggcattgttactaccgactttgacgaaagcacacctagtctaacgccaaacaccctatcatttaagggtcgtaatggtaaattaaattttggtggtgattatactgacaagaagttgagttataacggatatatgcaatcaagcaaccaatctgactacgagaacaagagaaactggttgtatcaacttttaggaagttcaacgcctttctacatcacgcctatttattcagatagttctcaatacgactttgaaaggccaggggaatctactggtagtaagttaggacaattgggcggaatagagagcaacaaaagatattatgtaacactagacgacacgtttgcaccagaactagctgggagtgtcaatggaaaacaaatttataaattaagcattagatttgtaacagctgtgttgccatttggggaaacaaaaccaaaaacggctacagtcacaaatgcaataccttatgcaggtacagtaaaggcatctcaattagaggtgcctttttacatacagctaactgccaagcaaacaacaagtgctatttctttaaaaataggttcaagaacatggacttacagtggaactgtggcaagtggcgatgtattcaagataggtggtgtatataaccttaaaaatactttatcagtgaacgacaacaccaaccttgaatactttactttagaaccgtctgccgttgggactgtttctatttcatgctcaattacggcaactattgagattcacgattacaaggagttatacctatgattacatttaaaaatatcgccggtaataagttccttgcagttggaacgatacaacgtaaaagcgcattaaacggagagagatcattaactggcgttttgtatgatggcgaagatgttcttaataaaatagataaaggttggtcattagaatttgacaatgagccttatgtcgttacttattttgaacgaaacgataatgacaatagtgtttcttttgatgcaatacacaaattcatttgggatatgaataaaagtgttttgtattctgaaacaagcggtagtcatactattaagtggtatttagatacgctatttgctgatacaggatacagttacgcacttaattttaatccaaatgcaattcaaaaagaaaattgggggatgaaaaataaactctcgctttttaatgatattatttcaagcattgaaggtgagtttgaaattaatggcacgttgatttctatattcaaaaatataggtacagacttgtctactattgttcgttatggctttaacttgtcagacatgactttagaaaatgatgctactagtttcgttacatatggtgagggatttggagaatacgcagaccctgaaaacatgacaggtgacagattacacgtgacttataccagcccacttgctagtatttacggaaagttgcaagctgaaccaattgataaccgtaactatactatttctgaaaatttgttagctgtggttaaaaaacaagttgatgatagtttttcggtttctgttaaattgtctttgtatgatttgtcagttgctggttatccctacaaaatggctaatgttggtgattggttgactgctgttgatgaaaacctagattttaaacaacgtattcgtattattagtattgatgatgagtttgctgctgacggaacaaggattagctataccgtaactgctggtggtgtcggtgtaacaaaaaagtatcaagatgctaatgcttcattagtaagtaaagtagaggaagctgtcgtttcgtctggccaagctataacggacgctaatattgctttaattgctgctaatggtaagaataagtcttactatcttaacggtgttgatgatttaccacagacagctaacgagggtgatttagcctgggtacaaagtggcgatggacgtgtcttatatatatacaccaagaaatctgatggatcgtattattgggaaaaacgtattgatccagagatgggtgagcaaattgtagctggcgttaatgatgcaatcgcgcaagctaaagaaaacactgacgaagccatttcagaaaacaacacacagattaacgaaacaattaacagagtatctaaagagcaagctgatttagctatcaaagatggcgatttcaacaacaaagcgcaagcgatggctgacaaggctttggcagacgctaaagataatacttctgccgtagcacagcaaacgattaatacagccaacacgaacatcgctactgctaaggcagacgtcgtcaatagcttgaataaggaagtttctgatcgtcaatctgctgtttctgcattagatagtaaagccaaggaatacgccgatgaagctaagaagtctgcctctgacggtttggtcaaagagataggagaccgccaatcggctattaccgctttggataacaaagctaccagtgccattaatcaggcaaagagtgacgtcactgatactatcaatgctttgtctgttggtggtagaaactatctaacaggaacatatattcctaactcaacggtaggagctaatgctaataatcagtcaaaggcattatataaaataacattagattctttagattctttgtataaagagttcaagaaaacaagtgattactttacactgatatttgattggagctattcaggaagtaacccttcaggacagttcgtgcctcagtggaacatagctccatggggtataggtggcaagtacacagtaatatcatctagtagcacaagtggaacagttaccttaataggcactataaattctaattggtctggtgtgacagctactccttatatgggtattcgttttgacaatgttccaacaacaggaactgtaacaatatctaatatgaggctaatgtcaggtaacttagtatatccttggactaaagccccagaagatattgtccttgattatacgactaaagataatcagattaaagctaccctaactcaataccaacaaacaaatgatggtaaagttactaaagcacaaactgacgctaccacagcgctgggtcaagtatcaacaaaggttagtcagacagactacaatattaaaactggtgatttagacacaaagtacacaaacattaaacaaacagtcgattcacaaacaactgaaattactaacatcaagaaaactaatgatagccaagatagcaaaataaatactattaacagcaccgttgatggtacggttaaaagcatttctgacatcaaaagtgaccagactaatcaatctaaaaagattaatgaaatcagcgatacggttgacggtacaactcaaaaaataaccgatatacaaacaaaagataataatcaagatattcgtatgggtaaaattgaaactactgcttctggtatgagttccgatttctctgcatacaaaaaagacgcagacggtagaatatcatctgctcaaactaccgcaacaactgccgtagacggattaaaatataaggtatctcaagctgattacgataagaagactggagaccttactactgcaattaacagtacaacaagcacagccaaccagtcgaaacaagatattgtagccattaaccaaaaaaatggacaacaagacgctcgaatgacgtctattgaatctgacgctaatggagtgaagacaactgtaagtaatttacagacagcacaaggcaagcaatcaggtgatatatctacattgcagcaacgtgcagatggctttgacgcaactgttacaaaggttaataatttatccactggtgaccgaaattatgtgttagatactggaaaccccaaaacacaaacctctaacggaaaagataatcaggacttttataatagtgccctgttttattcaccaattaaaaactggggtatagcaaacggtgattatataatatcgtttgattggactttaacaactgcattatcatctgatatgtccgccagtgtatttttcaatcaaagtccatggcagcctcaaatttttactgttaaggcaggacaaataacaggacatgttgatttaaagtttaagttagcagcagggatactaactacagccaatgatgttactagtttaacttttagaataatgagtcaaatggcttcaggaaatactattacgtattctaatttgttcatgaaatcaggaacgattaacaccacttggacaccagctccagaagacttatcaggagcaaccgctaaagcacaattaacggcagataaagcacaaacaacgattgatagttacaagactgacgctgatggtcgaatcaacaaagcacaatctgatattacgcaaaccgccaaagatgtgacaacgaaagttagtcaaactgactatgataagaaaactggtgatttaagtacatctgtttctaaggcacaacaaatagctgatagcgctactacaacaatagggaactataaaacaagtaacgataatcgtgttaaagctgcagaaacgcagatagcacaaaacacatcagatattactttgagagctaccacagcagatttgaatagcgccaagagcgactataacgcccaaattgcacaggttaaggtagacgccaatgccatcagtcaaaccattagtcaggttaatgtaaaagttaacaatttatatcaaaataatttaattataaactcagacttcaaaccggatttatctggttggtatatatctggaacaggaacatacaccacaggagattacgattatagcggtgccgtacttgttttaaacaacaccgcgggtggtattgttaatttgtattctactgcagtgtcattgaacagtgtccaaagtgtcgttttatcgtggaagttaaattattatattttcaatgttggctctggcggttcttcatatatttatttacagtatttagatagcgacaaaaacccaatacccaatatatttatctatgcacgagacgtatcagccaatagtggttggaatacctttatcgtaaataattttgctttaacaaatattccatctaatgcaaaatacattcgtttagttgtagacgctcgctcacaaggaactagaattggcataaataagcccatgcttgtaaagggtacgagcgcaggagattatgtttctggtcaatatgttaataacgataaaatcgcttcacagcaaataaccatagacgggataagcaatacagtatctaatcaaggaaattcaattaacagtttaacttctagagttcaaacagcagaaggaaatataagcaccgccacaaataatatatctggattgcaaaccaagataacgcaaacatcaaatcaaatctcgcaagaaataactgatagagccaacggagacgcaaacaccttacaaagttctaaggacttcacacagtctcaaataacatctgctgtaagtggagttaatagtacgataactcaaactgctgatagtattttggcacaagtagatactattaatatgatttcgaactctgaatttgatccaactaatgttggttggtatacattcagcaactcatctggtgcatctcttggcgctgtatggaatgccccatctacttctgcattcttagattggccagcggctggcgggtcaaaattaatatcatataatgtttccacttggttttcttcggaacctaaggttgctagtgctggaaaatcatatagcggatcaattgttgcgggtagaacagcagcaataacagcaacacaagcacttgatctaagaatagcattctgggattctagtaagaagctaatatcaactgctagtggtggtaatattattgacggctcaacgtataaaggattaacgaaatatgttgctgaaaataaagttgccccatcaggaacttcgtttgtttcattagttatagctcactcaggggccgcaccagatgttattggaagaccaatgttaaatatcggatctgttgcttcaacctacatgccaacaacagcaacaacatcttctagcactatattgtccttattcaaggacaattggagcattggaattgctgataactcaaaagcgcttgcaagtggcattatgggaaaccctgaagccgtttatattgtcagcactaagataatactaaatggagatacaaccgtagcagggacatttacggttgggagggcaaacatagctgatggcgctattggtacagctcaaattggtgacgcttcgattacaaacgccaaggtatcaaatttagatgttaataaattaactggtaatataactaatttcattcaatctaattggaatggtgtctatggtagtacgacgataaccagctctggtatgaccatagtatcacctggaacagtcgctttgtttaacgtgaacggaatgacgttagatggcgccggtggaatgactagagttgcaaatggttttacacaaatttatagtgctactcacgaaaacatcggtatgataggccaccaaaaagacgttgaccacgataacgttgattatattacgtttggtttgaacggatatagaacgactaatgagggcgattctcattgggtcggaggttccgatttctatggtggtgacggtatggggttcggtgtttctaacaaaaaaggtacctacgatttgaagcttaggtgggatagcgacttgatagctggctataaaggtgagattcaaggttggcatgccagcgacgcgtttatatttgatgataaaacgtatcacaaagggtacgccgacttctcagcaggagttacgatgtccggagcctattcagaagggacgcgttccttgcatactcagggaatgagtatctcaacaggcgcaaaatggttcgggtttatggacggtagcaatagcacagggtttggtacagatcagacacacgatgtactgttttacgtcaaaggccaagtatattctttgtataccatgctaggtaaattaggcatgagataaaggaaagtcttattcgctttatgaaaatgtaaataaacaggagaataatcatggaaattaaaaaatcaaatttggtaaacgtgtttcagttcttaaatgatgttaccttagttggtgctgcttcgcgagcaagaactaaattaaataaagacattagtgaagcaatcaatgagcttcaagaagaagaaacaaccttagcaaaagaaatgggcggtgaagttgatgaaaacggacatgttgattttaaagtcgatgaaagcttttctgatgaagaattagaaaatgctaaaaaagaaaaggcgattgaattttctaaggctcaactagaactacgacaagagaaggttatttttactgaaaccgtaaaagatcagtttaaccgacttaaaaacgctctttatgattacgacaaagaattaaatggggcagaggcgaatgtatatgacatggtcctagatgtcttagaagagtaataaaatatcaaccagtaggttataaaactgccgcgtgggtgaaacgcccgatagcaaagtaaacgataggagaaatatcatggcattaacaacaaacgtgacagacgcacaagtagaatttattgatggtaagttagcaatcaaatatttcaatgtttccatcagttcaggagtcttccccaacagccttaacggaaacgttcaagttacagcaacagatggtgtttcgattacatcaacgccagaacaagttgaaacgattgctaagaagaaagttcaagatttggttgctgatgaaaaagcatctgatgcataatttaagggggtgaataatgcacggagcattgggagagttgtttgatgaaatagggtgggttggcggagcaattgtgacacttactggaacgactatattcggatggataaaattatggaccggacaatttaaattgttaaaatccgcaagtttggcaactttgcattcacagttatatgaaaaaggcggtaagtatattaagcgtggagaaatcacgttgagtgaactagatgaccttgagtatacctggaatgcgtaccacggtttaaaaggtaatggaaccggcgaaaagatatatcaaaagtgtcgcgacctaccaatcatggattaccaaactaattctgattggcaagaggttgaagaagttgccgcagaacatgaagctaagcgtaacgcctagcttttttatttggaggaaaataaatgaataaattaaaacgtttagcagtcgcttcagcaagcgctgcttttttgtttggcgtatcagtatcaccagtatttgccgctaagggtgatcaaggtgttgattggtctatttataatggaacagcaggacaattcggttatgctagtgataagttcgccattgctcaaataggtggctataacggcaatggtatttatggccaatacacatataactctcaagtagcctcaggtattgctcagggtaagagaatgcacacgtacatctggtggcaaaatgttacaagttatgctgttgcagattcaacgctagactacttcttaccaaaggttcaaacaccaaaaggttcgattgtagccttagatgttgaaagcggatatcaaaatacagatgttattttacacgctatggatagaatccgtaaggctggttatacaccaatggtttatggatacctaaactatctgcaaaacaacactgacttgtcacgtattgcggataatgtacaactttggttagctgaatatcctaactacgcagtaacaccaacaccaaactataattatttccctagtttcaagaacatcggtgtttttcagttcacttctacttatgtagcaggcggtcttgatggcaatattgatctatctggcattacagataatggttataacggttcaactaccactaattctggtaagacgacggttaaaccagaaactagtactccagctaccaatgccggacaagctgctaataatacctctaagactgatattaaggcaggagacacagttaaggttaactttagtgcaaccaactgggcatcaggtgaaggtattccatcatgggtcaagggtaagtcatataccgtcgctcaggtttccggaaataaggttttgctaggtggcatcatgtcgtgggctaataagtcaaatgttgaaatcgtgacaactacgtcagcgcctgttccatctacgtcaacaggttcaacttatacagttcaatcaggtgataacctcagtaccatcgccgctaaatatggcacgtcatcggcaacattggcctcattgaatggcattagcaaccctaactatatttatgcgggccaagtattgaagctatcaggaacgtccactggttacgcttcaacaagcacttatacagtaaagtatggcgataatttgagtacgattgcatcaaagtacggtacaacaaccgctagtttacaagcgttgaatggtattttaaatgccaattacatttatgtgggacaaacactaaaggtttctggtaccacatcttattcaacaacgcaatcatacactgttaaatcaggtgacaacctttggctaattgcttcaagattaggtacaacagtttctcatctacaatcaatgaacagcgtttctagtttgatctatcctggtcaaacattaaggtattgaggagaacacatggacacaaatacaattactaaattaattacaacaatcgctattgcagctattccaatcattggtgcatacgtcagcaaggtgattttaggaaacaagcaggtggttaacctgattcaagtgttatctccgttagcaaaagattccgtagtggctatgcagaaattaggcgtaacggagtttttagagggtgaagctaagaaatcgggtgctgttaaaattgtcactcaagcactaactgctttaggtttctctgatgcagacgaaacattaatcaagcatgcagttgagaaagagtatgctttattgattaatgagttgaatcagacatacccacagatgacggctgaacaagataaagcgaaagagttagcagcacaacaagctagtgaagtagcgaaagctgatgggttgtccaaagcacaacaggaattggctgaggcacaagcaaaagttaacgccttacaaaattgaatataacaaaacccgcccgactggattatttctggttgggcgtttttttataattgatatgtcaaaatatgttattataaagttaagaattggtcatggaggatgttatcacatggacaagaaaaaaagagatgcaatagaaaatatagccgaagaagttcgtcgaatcgttatggcgggaaattcggataatcaaaatttggacgtttatttaagaagtgctggtgtccaagttaaatacacagatttatcagacacccaaattgacggatacttggagtgggataccgaatcgttgcaaccaaagatagttattgatgcatttgagcatccacaccgcagggttttttctatagctcacgagctcgggcatctagttctacactggaaatgggtaccaaccatggatgaatttaataaaaattcgctaattacccaacagtcgggggtggttgatgtcgcctataggagaacggatggcgagtatacagttcaagaaaaaaccagagaaaccgaagctaatcattttgctgctgcttttttgataccagaacaagatgttattgattatatagaagatgaacaaagagacgggaaaacgggatcagaaataattatcgatatcggggaaaagtattttgtttctcaagaaacagctggtattagatacagaaaagctaaggagtttatttaatggcagctgctggtatcacacctgaaaaaatgaagcagcaacttaatgggtttgaaaataaccgaactgaccttcctgcatttggtgatgtgtataaagaatttcaaactgacgaccccaataatgcagtaagaaaagatgttgcacgaaaatatagcgatgcagttaataaagagttggactcaaaagggtggtatagaaaatttttaataatagccataatgataatttttagtgccattacagtaatggttttcatagcgattttcgatacgcatatatcagattccgtaaaactatctttaataggcggattttttaccaactttattggattactgataatagtattcaaatatgcattttctagaacatctgaattgtacaaagcaatcagtgatttgattggtaaatgattttttgccctcaactcgcacaagtggtaccatacaaaaaatcaatcggattaagttctggttggcttttttgtttgcaataaagaacaagtgttcgtataatgtcatagaggtgacattatgaactatgacgacaaactaatcgaagaaatcaataaacgttttacgaagaagaaaaacaccctgtattgggtacgcatcgtgtatcaaagatattctaagcagttaaacgtgttcttcgaatacgccaaaataggcacggccacacattctgaacaaataggcagatacgttgaatcagaaaaggatcgtatgccggaattagcgaagcgcatcaagcaagagacaaacgtaagtgttgaacttgatgattttggataaaaaaaccggctagaaattaatctagtcggcttttttgtttgtagcaaatttgtagtaaatgtagtaaactttaagtgaaaaatagtgaataatagtgaacttttataaaaacagtaaaacaaaaaccgctaataaaaagtgtaaaaacactgatttatagcggtttatatcaggttgatgttccaatttggaatattattaattgccctgttggcatatctagacaaaaaaaaataactgcttaactttggtgagtcgcagttacttttttaaagtttaatctgtgatagtcactatttgatatagtaacgttgtagagtcacgtgttagagcacgtggctttttctatacttaaattgtataacaacatgtgtgcttaatgcaacaattgaaaatattaattatattatttaattactaaactctatatcatctgtaccatcgctagtagcgataattgttccattaggtaattggacattgattgcaggattattcatatcgaaaaccacagcttgtctgtttgcaatagtttcaagtatgtccattgcgtcacgtaaatcggaattagaatagttagcccagtcatcatacccaacgtaagttaatgtgttagtgctcttatcataggttgcatattgagcagtgccttttaataatgaatttactttatcctcatagtcttttgagttatcagtacttgaagagctactagattcaatttcatcagaacttgatgattcatcgtcgctaaagctttcagaactatcttcctctgaactagaagactgtttatggctgaccgaagaagatgactctgattctgaattgccagaattatcactaaaaattgataatccaataacggcaacaataattacggcgcagattataaaaggcaatggatgtttttgtataaagtcttgtttctttggtgggcgtctcatgaaattatgtttctctctattaatctattgttatatccacatctaaatatataccactaattaaaatatgcaagtttacataagggcggttatcggcactagccggtacgacgccgtttataagccgtcacttgtgaatttcaaaaattcgccttgtgaaggcttatttgttgcacgatacaacttgtgaaatccggctggttcacaatctataccacctgttttctctcaccggcagggctcggccctgttccacctacaaaaacacccagaaatcacgccgttttaagctgaaatccgggttttgaaaaattttcggagtccggcaactctcggtaccgaaaaaacctgtccataatcttgacatcagcgccccccataaaagactctaacgtcttaaaaatgttgctttttaaaactatacagtaaaaaaaaacggataccaagtataaaattaggtatttgttttttgtgagctacataaattcacaaaaatcgtacctctctcgaataacgagatacttttttagttaaaatgcttgataattggctatagttttattcatactaatagaaaaagaaaatacggaggtatgttatgaccttttcaaagagtttaaaagaattacgtttgctacatgagttatcacagacacaattagctagaaaattaaatgtttcccctaaaactatttcaaactgggaaaatgaaagaaatttaccggatattgaattgattattaaaatatctaaagtcttagacgtaacactggatgaactaattactggtaatattcagttagagaataaactaatcaaagatagtcataaagtttttcgtgataatgtaatgtctatcgtggtgagtttatattcgatgttaaccggtatgttagcaatggtgtggtttttaaatattcaaaccccacttcgtaccattgttttttcaacttggttatttgttggcttcatttttggatatatgatagagcctactgataataaaaatccttttgattctatatcgccaataattcgatatagcttcatagcactgttcattgttttaggcttatcaataataattggctcttcttggttgatcgtaaactatccacaaaaaattatttacttcgttactatgatagttggagttgtcataataattatgactaaacccatttggcccacaaaaaatagaaatgctgaataattcagaaatgattgagttaaggggctataactatcaattgtctctgttaaatactataaaaaaagcctctaacaaatcaacttggcttgttagaggctttttttatttagataatataatagcccttgaaatgtaaggctaaattgaatggctaagcgttgctatatagaggcgcataaatactttgtttctcaattttggctaggcatgttataatgaatacagaaaaaggaagccttgcgctaacaagacttcccattatagagccgtataagacggtggcaaacttaaaacgattaaataaccgctagcttggcagagctaaggcggttattttttttgttggtttttaatcaactcaacaactaatgctagtaaggtaactatgaaagtaccaaacattagcataagctgtaaagcgtccgatacggacacttgggctactcctttcctagaatgtgagtttatagtttttacaccataagcaccaccccccttaaggaaatagccaccgccttaacttctctacttgaactattatacaggataaagcgtgatttacctattgatgattaatgctctaatatcctgaacggctagttttctattttcaatataaatataattatccgacatgttttcaatgaacccagatatatttttttttggtttcatgattgaagttagtttcatctaattgaatagtcacagtataataatttgctaatgcgtgcattgcattatgaaatattttatccgtagtcattttgggtaactttttttcactatatacattttcctgatccattttccttaatgcagaagtatggtcgcttaaaaagaagccacgccactttttaatgcccctatctctataatcatactgaaagtaattattgattaaagcgctaaaatcttgatccatttcatttctcatttcaaattttttattcctcaattatacgaacgttagttcccttatgcaagcggctcgattttaaacttttgttatattatatatgtagttcaaaaatatagactaaaaggaaaattttgttatgcttaaaatactaagtgaatccatataccaaatttacaagtttacatcagggatagtatcatggggattaattaatatacctgttagctggttatctttttttatagccatcataggtttggctaggaataatcataataaattacgacaaagatttgattattcatcagtaacccacccatgtaatacagttattactgtttacaacgacagtttagtaacagaaacttcacgatttaatggaataatagtcactgcaaaaaagccaaacttactacggaaaaaagtaattaaatggaatttgaaaaataaaaaatttggacataataaacagcttttattcccttttcatcaaatggtaaatattcagaataacgaagaaataaaacaatctgatttttttgctgttaagagccatgaaatgagagaaattataatcaataaaaaaaattttttaaattcaataaaaaataagctatacagtaatattaaggcacttacaaagtttactaataagaaagcattttatgtatattttgtttatgaaacggttactggtaaaacaagaatgtttgctgttaaaattatttttgatgaccctattggtcaggatctaaatattgacgattgtaataaagtgctacaagctaaattaaagtacaataactaacaagttaagggtaaaatacaactaatatttaaaaaaagggatagcattaatagatggattacactgaattctacaaacatgttaaaaacgaattgaaagttaccggaacagataaccagtttcatctgtattatgatgaaacaaataactttagatcttttaaagtagacgataaaggttttaatgctgacgaacatgcctatttcatacttggaggaattggcataaaaaccgactcgcatgacattgttgaaggtgttgatagcctcttctcaaaatttggtatgcaagcaaatgctcaagaaataaagtttaagcatatcaagaatggtgccaataattttattgagttaatggataaaaaaagagtaaaagtttttttgaattggctttatgaaaatgacaatgtttttatccactataattatgtagataatttttatttctctattgttgactctttacccaattcaatgcttctcggcatagaatttaatcgtgacctaaaagattgtttgtatcaaattatgaaaactgataaagaatattttacaaaccttttcgttttattaggctatccaaatgttaacaaccctaaattactaataaataaaattatagaaaagataaatgaaattaccccatacggagatgatttttgtttagagtatttacgacagatcttaaaatcagcaattaggtccaaacttcctcttttagaaaataatgtcgagggtgaattgatagataactactctgatctatacgcacagagtatttattcttttccaaattctcatcacaaatttgatcatgaatataatattgagccatttttagcgaataaccctatttatgtaaatgacaaactagtagactatatttttgatgattctaaacattctcgattattacaattatctgatttaacagttggcattttaagacattggatgagtttccttgaaaaaaattcggaatcgaaaatttcagatattttaaacagtttatctagcaatcaagaaacaaacattcgaaaattacaacaagttatgaacaattcactatctgaaagtcagggtttcaaaattggttctgggagtaatacgtttgaaaataaagtttccgatttcttaacttataaattttaactagaataattcagatactcgcttattactgactataaaagatccagaacatatcaacttaaggacggtaagaaattatattaaatttaatttgcgatacaagataatgtgcattaaaaggtgacatatcttaacaattgtgtcgctttttttttgtgccttataattaaaggtgttaaaataagtcataacttaccaccataaagcagtccaattaatttattgacttctaagtaaaataccaggagttttgctatgagttaactatgatcctaggtggtcactaaaacattccttaattcagggtctataattataataatggcactttaaagcgccacaaagtacatagaagaccttgatacttatacacctatgttgatggaagcattgcatttaagtttatggtgtatcatgttgttatacaaattaaaattataggtggtttagaatgaaaaaaatttattttttatgtacaggaaattcttgtcgcagtcaaatggctgaaggatatgcaaaaaaaatattgccggcaaatgagtttcaaatcgagagtgcagggattgaaactcatgggttaaatctaaatgctgttaaagttatggctgaagatggagtagatattagtagccactactctaaattaattgatctaaattatttgaacacttcagatttagttattactttatgtggtgatgccaaggataaatgtcctatgcttccccctcaaaccaagagtttacactggcctttatctgacccagcgcaagccacaggaactttagaagaacaactacaagaattccgtaaggttcgtgacgaaattaaaaaattagttacaagtttgaataactacgttcattaataaaaaaacgccatatagtgccgcagcaaaacagtccaattaatttattgacttctaagtaaaataccaggagttttgctatgagttaactatgatcctaggtagtcactaaaacattccttaatttaggggctataattatataatgacccctaggaaagactattaaaacagcccccattatctaatagttagataacgggagttgtttttttataaaatgatataatactccctatataggagaaaacgtatgtctagacaaaaacgatcgatcaaggaaaataatgataaattaaaagttcaattagaactcctccgtagttatacggaacactttgactcaggtatgattcatatggctttgccaatggctacacaggttcgtgtattaatacatcaaacagataagtccaatttattgacttctgagcactttttcatccggctgttgtcggcgccgatcattgtgcgatcgggggtgggcatatgaattcattgattagtttagaaaaagttaattatcaaatcgctgatcaacatattttacatgatgttgattggcagattccagctggggctcatattacattgacgggaccatccggtggtgggaaaagtacgttattacggatcattgcggccatgatttctaaaacaagtgggaccttgatttttgatgggcagccgcttgaaagttacgacccaatcatgtatcggcggcaagtctcatattgtttccaacaaccgacgttatttggtgagacggtggcagataacttagctttcccgtaccaaattcgtaagcaagtcatggatacgcaacgagtggtaacggcgttaaataatgttgggctgtccgaacgaaccctgcatcagccgattatcgagctttccggtggtgaacggcagcgggtcgcgctgattcgcaacatcttattcttaccaaaagtgttgttattagatgaggtgacagctggtttggatgaaaataataagcaaatcgtgcacgcctggttacgacagttaaatgagcaggatcacgtgacaacgatcatgattactcatgacgcgacagagattgctgcggcagatcaattagcgaaagtggttgctggcagattggaggtacacgcatgaatttagcagttaataatacgtcgctatttttggcggcaatgttagtgctcgtcgcgttaggaattagtttgtggcagaaacttggcttggatagggacatcgtcattggtgtcgtgcgggctgttgtacaactatttatcgtgggttacttgctaaagtatattttccgagtcaacaatttgtggctaacgctggcgatgataggcttcattatcttcaatgcggcttggaatgcgaaaaaacgggggccggggattgaccatgcattagccatttcgttattagccatttttgttagtacgggggtaacactcggcgtcctcgtgctatctggtgcgattaagtttgtgccatcgcaaatgattcccatttctggtatgattgcgtcgaattcaatggtcgcaattgggctggcttatcgcagcctcaatagtcagtttcatgaccagcggcaaggtgtgcttgaacggttggcgttaggggctggtctacttgatgcttcgattgccatcgtgcgtgaggcgattcgtacggggatgtcaccaaccattgattcggcaaagactgtgggtctagtcagtctgccagggatgatgtccggtttgatctttgcaggggtcgatccagtacgggccattaggtatcaaattatggtcacgttcatgctcttatcagcgactagtttggggtcaatcattgcgtgctatttagcttaccgtaatttctataatgaacaaaaacagttgaagtaatgactcctgattgcagtcccgcggggagtcctttatgatggaagctgaaataaaacttaatgcgggggtattgatgtgaatgacgcagcggtttgggttccagttccagcaatgttttactggggctggttagtaccactcatatttggaaccatttttggttggcgttatcatcgcgataaggttcgcctaggtaacggtatttggttttcgctatttttctattcgtttttaaccatgctggcgattacaattttaggtagcaatatccactggttgatcattatcagtgggacgttgtttgtgttgctgatcctgttgtttgtgctaattcagcctgataaggttgacatcgagataattcataagaaattgttgacggtgatcggttcagccgaacgcccatttggatattggacagccctagttcacaaaaggtttcgattttaattcgttcggaataggttatactagacaaaagtgaaccaattataggcaaggactgttctattattgaggttaaatagatatgcaacaaatcgtactcccaatcaaagactctaacgtcttaaaaatggtgcaagacaccttactagatagttttcgggcaggtcgccgtaactacaccatctttcaagttggcaaagccaccctgctgcgggtgagtgatgtgatgacgttaaagaaatccgatgtctataatccagatggctctgttaaacacacggcctttattcatgataaaaagaccggtaaagcaaatacactatatttaaagcccgtgcaacaagacttgttgcaatatcatgattggctagtccaacagaatatcaattcggactggttatttccttcaacggcccatccagaccggcatatcactgagaagcagttttataaggtcatgtcacgtgttggtgatctattaggtatcaactatctaggcacacacaccatgcgtaaaacaggcgcttaccgcgtctatacacagtcaaactacaatattggtttagtcatgcacttactgaatcattcaagtgaggctatgacgcttacttatcttggcctggatcaagcaagtcgcgaaacaatgttagatcaaattgattttgggtaataacgccaactaatctccctaaattagtacgtatttgttcattttgacgccactatggaggtatttttaatgactaggattactaaggcacaattagacaacatcattacacgttgccaccatccgaggtaattggtgccccattgtctgaaactgcaactaaagggttgctaggtaatactttttgagtcataattttagacgctccaatttttgagtatttggtttgtttttcactaacaaaatatcataacaaagagctcctatggttttcacccaacgggtgaaagcgcaaaacccgctgaaacggtattaacttgctgtttcagcgggtttttgtttgtcttgatgaataatccgggtattaagttctacaccatctcacttttctcgaccatagagcgtctttctagatatccccgaacagatttactcacctgtttggggttttctttacaaaaaagtgttttttgtcagcaggcgtgttggtaaccactaaaagtaactccctaaggacaccattttcgatgacgtaatataacatatcgtttctttgtatacatggttagctattacaggtcgactcaattaaaggtgttctaaaaatatgatttaaaattttacccggattatttctaacgaatcgacaggcaagcaccctgatgcgctatactctgctgatttaatgaacgcagctaaagaagaagctaagcatcgaggattgtttgacttaaataatctataactgattaccatataactaaatatctaaaaagaaaaacgtcttgaatattcaaggtgtttttttgtctacaaataataattcagtaagataccaacgccataagcaacaattgcagcgacgtacccgacagaaagtgtgcgtagaatttctgttcttactttctgctctgacaggttggccttcacccagcctagcaacgccaaagagacaccgacgatgacaaaggcgattggaaaggcgatgtctttgtcgtgaatgagcgcatttgtaattaagtaggcacctagtggaattaaaccgaagacgttaaacgaaatgaatgtcgcgataccagctgccaatgctttactttttgattgattgttatccgatgttgctgacaggtaggcaccggcccccattgaaaagccatcggctaataagtttgagaatcccaaaatgatgataacgatgtttgaaacgttaccaccgaccgatccagcaacgactgcgaacgtcgtgataatgccatctaagccaccgtagacgatggctgaaacgtgttttttcatttattttctccagtttctctcagtggtgataaaaccaatatataagaaaaaagtgaccaattatcggtaatttcacatcggattaaaaatgtttcaaaaacgaaacaaataaaacccggattattcatgcactaaatttttaaccacagctaaatcagtaaaatacgataaaacaccttgaaactgccagtaccttggcacagtttcagggttttttttcgattgagcgttttttgagaaaaataggaacactaaaaccagccagattttgctatttttttgaaaatctacttcgttgttttattgctacaaagcatttagtcgttcccaagctcgccagaacagaccatcgaattgttcttgggtgcggctatctaacgtcaaaatcaccttgcgggcgtgcttagtgacacacgtccaccgatttttaacaaacggtctcgaaaggtattgattgtccacgattgttgctggtcgtccaacgcaatactcttcatcaaccgcatcaagtttgatacaattactgagatccacatgcgcgctttgttggcgaaaaatgaactgctatcagttttgccaaaggcaaatccacctttaagctcgcgaataatatcttcaatcgccgcacgcttgcggtaaacacggacgatgtctttttgtggaagacttaggttagtgacgatgaactgtgtaccgccatgttcatcatttaaaacgatatccttatttttaagtataaatcgacttaacttgatacaaataataattcatctaaatcaaatatctcaacacatttttgggtatgccgtttaattagacctctctcttccaatgatgagaacttacggcttattgtttctggagttgtccccaggtaagtagccaaatctttttttgacatgggtaaagtcacataagtatggtttttttcatcttcaacattttctgatagaaaatcaataattcgagcttcaacaggttcagtactgacttgcacagtttgtttttctgataactgtagccgttttgtaatatccgataatattcgtcgcatgatttctggatagagatctaaatattgatctaaattctttttatgaatcctacaaatacttgtttccgatattgcttcagcataattcgaatgataactttcagtctgtaaaatagcaacttcccccataaaatcaccaggatgtaggatgcgtatagtttgctcacgaccagactcacttaggctataaatacgtacacgtccattgtttatgatatataatgtgtcatctttatcaccaaacctaaataatagctcattctttacgtattgtacttcattcgctgattgagcaattagacgcatttgttcatcattgagatgattgaaaatcggcactaaacgtatacaatctacatgactatgatgattatggtttgccataccgttttcctcctaattaatcgttatctatatagtcatcgtcttctaaggcatccttattaataaatgcttgaagttgccaaatatttacgtctaaataagctttataactaattagtgaatcttccaaagcatcatttccttcttcttgtgctaagcgaattgcacgaatagtaaattcacgattagatctaaaatcttctactatctgtaggaccatctcatcagcagtgtaatatttttccgaagaatcttcagaaatcgttgtaaattcttgaaattcagtagttgttgatgctggcttaaatcctgaagctagtaaacgttctgcaattttatcaaaccatgcctcattctcgttatataaattttcaaaaacattatgcaatgcatagaaatttttgccttttacataccaatgatattgatgtaattttacatgtaatgtatgaatattagcaagtatatgatctgtaacagctgcagaattaatcttagtatgatgaatgtgttctttatatgcttgttcggcagctaatttttcttgcctttcatttatcgttgtcattttatgcaccttcctttacttttgaactaattactgggtatcctaagtcttcaattgctttttcaattgtattcaaattgacctgattttcatcaaaatccacttttaccttactcgcattgaaaagtacttttacagaatctttttttacaccagcagtctgttttaaaccatgttcgattttttgtaaacatgatggacaagttaatgtttctaattttaatgttgctttagtcatatctatcactcctttaagtaaattatataggccattctttttaaaatacttgatatagatcaattatcttaattgataacctcttaatctcattgcatttaaaataactactaaaatactggcctcatgaaccaacatcccaattgacatagacatccattcactaaatattaaactaaccaatagtattattacgactccaacagcaattagaatattttgtcgcatattcgcatatgttccttttgctaggcctaaggcatgaggaaggcggttaaagttagaattcattaaaacaatatctgaactttcaattgcgacatctgttccattccccatagctatacctacctctgcagtagccagagagggactgtcattaacgccgtcaccgataaaaacaactatttcacctgagtcctgtcgtctttttagaaatgcttgcttgtcctctggtagcatatcaccatgggcttcggttaaacctagttcctttttaactgaattaactgtaccttgattatcacctgataatacaatgagatttttaataccaagtgattttaatttttgtaagtcctgcttaacacctggtcgaactttgtcgcggatacccattaacatgattaacttatgatcaactgccgttaatacaattgaattaccggttctttctaatttattcaattttttaagaacatcatcagatagcggtatactttcttgtttcattaaggctttattccctactgaaacaatgtgcccatctacgtgagcaattacgcccccaccttttacaacctgtgtattttctataggttttaatttatattgtgctaatttatttgcaatagcaacggctaatggatgatcagactcattttcaactgaaaacaatagcgataaatcctcctcctgattattcccgtagtgaatcatctcgctcacttcaggctttccttcagttaaggtacctgttttatcgaataacactgtatctgcattggcaaaatgactaatcacttcagaacccttaaataaaataccattttttgcaccatttcctatacccgcaacatttgaaacaggtacaccaattaccaaggcccctgggcacccaagtactaatacagtaatcgcaagttctgtatctttggttaatacccaaaccaacagcccaattgtaagtactgcaggtgtataccagcgagaaaactggtcaatgaatcgttctgcttctgatttagaatcctgtgcttcttctaccaactcaataatttttccaaatgtagaatcttcccctactctatcagccactatttgaatagtaccattgtccataatagtaccggcaaatacttcatcgtctttttctttctttaaaggtaaagattcacctgtgatattagcctcatttacatatccttttccagtagttacttgaccatctacgggaatcttggcaccagtctttactaggagaatatccccttcttctacttcatcaatatctacttctgcaaattgtccccctgtcaattgcttaaaagcagtttctggagccatttccgtcaactctttaatagctgatcgtgttcggttaagtgttcgttgttctaaatatgatccaaataaaaataaaaaagtaacaattgctgattcttcataattttgaataaagagagcaccaatgaccgctatcgttactaaaatatcaatacttactacttttactttcatagcctgataagcctgtaaagaaatgggggtaacgcctaatatcgaagctataataaaagcactattagaaattgttgtattggcaaaaataaagtgtgcgattagtcctaaagcaatgagtaagccactgatactcataattttatttttatgtttaagaatattatgttgcatatgatttctcccttaattttagttcaactaaagtgtattaacttttgggagatataaacttgacgtccatcaagtttatgaaatagttctaaataagtaaaaatattataatattggcttagtcatgcacttattgaatcattctagtgcggccatgacactggcttaccttggtttagatcaagccagccgtgagactatgttgaatcaaattgattttggttaaactcattagctataactacagttatagttgtagttatagctaatgctcataagtcaataattcggaataactttttgttttctgctccttttagaaacattacaaagttagttttcttttgttaaaaatataaaccagtttaattaatgattattgtttacggtttcaatacttgaacgaataatcttcttttcactcgcaggtaagttactaatatattcttccacaatatcattaattacctcgtaaatttttttactttgcaaagtggcaattgtgctaatggctgtgtgtgtgtttaatgggagcctaatcgattttggtaagtctttacttgtaagcctactttgtggaagctttagcaagtcttctggcattgtgcggttaatatcttctgatagttctggtgtaatattttctgggcgctctgttttcttttttcggaatgagcttagtccaatattgtcagtcatgataaatgctccttatttttgatcaaatatatttatgcgctcgagcgtttctttgatgagatcgccatatattgcatgtatacgtttgtcgtggatatccttagtattatcggtaataccagttctatcaaatctctttagtctgttcatctgtttaatatgagttttgaagatattgttatcaccaaagctttctgtggcatcttgcaagacatctaaatcaagttctgatccattttgttgtagtacgggaagtattcctaaaagatctatattcagaccatagtcatcttgtaactctaataagtgctctatatatttttcagcaccttttagagcccgttcttgtgtttgtagtataacgattacaaaatcactggctaccagtgcattgtctgtaaatttgttcagttgtggtggaatatctaaaaatacaaagtcatattcatttttgaattcattaatgaaatttgttaagtgatgatcttgtgagtaatcatcagaaaaattatcataaaggtaacgttcatagttttgtaagtctgagtaagatggtaacaaatctagattatcttttacatttattaacgcttcctgtggattattatttttgatggcttcaaacagtgtttctttaaagtcaggtttctttttataaatattagtcattgttgttagcaataaatctgttgcattagcttggggatctaagtcaattagtaatactttcttgtccattttagacaatgtataagacagcattacggagtttgttgtcttccccaccccacctttgaagtttccagttgtgataactttagtcattcttaactcctttataaaattataaaattatgtatttataaaagtataaaagtataaaagtatatttttataaaaatatatttttatactcaatacatgctaataactgatacgtaaacactttttttaatttataaatttatactatcataaaaatataaaagtagcaaaatataaaagtataaatttataataatataactttataaatatatacatatcacaataactttataaaattattgacatagcggtagctattacgttatattatgtgcataaacataaattgagataattaatttattacaaaaagaaaagccaccaaggacggcaatccttgatagctacatgattcttatatgtacgagaatgtgtatctatattatataacataacctttgtgttgtaaatgtgggtgatttcaaaaagagtgaagccaaacactttaaggggtatggcatatatgacgtgtagggggtagttacctagtgtgactcggaagatccaaatcgctgtatatggtatacgaaaaaatagacaagtgccattttcccagacactactgtacaaaaatatgtgggtgctacacaaacaatccatactgggcgtgtagtagggtgagagcggccacaaacggctcggcaggtaaaacggtgtctacggacacagggcttgtatttaagctgtataacgcgaaaaagataataaatatagtgatacagcgccaataagggcgtttttttattggtttaatgaataaagtagttaattaaagcaggcgggtaaaaccaaggcttgtatggataaggtgacggacgactgaacgatcggtcaagtgtttgttaacagtaaagttttcttcttcccaaaacaaggggaaaactatcttcagctcaaaacttccctcactctcaatcaagcatttgtaacttcctgtgtcaacaacttcttttagttttctctattgatttagatttaaagacaataaaaaaagtcacaatcataataataaccacgggcgatcttaactgttgtggtggcggttggctgtcgcgcggtttccgtgtttggtggcagattttatttgatatttaattgataatttttataaatatagttggcaattgtttattgtgagaagataaaaatattcttaacttgtttttcttcttcaaagacctgtttagctgtttgaaaatagaataggttaaataagcggatgcacatagcttgattactaattccgaaagagttgcgcaaataattaaaaggttttctatcatctagtaataattgagtggattttttatttgctaataatatgctagccatattattagcctctttttcaaggattcgatctttttcggtataatcgttttctgcattagagacggatacgtttgcttattctcgtgaagtaagaagtgctcgtatactgaaaatccggactgctttatttctagggcataatccgagataatcaagtataggagttttttattatgaaagctaagcgatactcaactgaatttaaatcaccaattgttgccttgcacaatgagggccattctgctaattccctagccaatgaatgtcatttggctgtaaaaccgtcacgggttgggtcaaaaaggctcagatcgttatgactgatgtgagtggtaagccagtgactcgtgccgaatttaatgcgatgcagaaagaagttgcacgactcttggtagacttttatagtttagttgtgaactaataaatcaatataagtttgataaagtagcttataataattattatacattggttaggagggggaatatgagtattattgatgatatagcagcagatcaaatgaatatggagtttactaaaaaaggattaaggccaatatttcacgtatcggaaaaagcaaaattagtcattattggtcaagcaccgggattacgagttcaaaactcgggtataatgtgggatgatgcatcgggagatcgattaagagagtggatcggggttggtaaagataccttttataattcaggaaaaattggcgtaattcccatggacttttactatccaggaaaaggaaaatggggtgacttaccgcccagacgaggagtagctaacaaatggcacccaaaattattggagcttatgcccgatgttcagttaattatattggtgggatcatatgctcagaaatattatctgaatcttggttatcaaagcaagataaccgatgtaataaagaactacaaaaattacttgcctctttattttccgatagttcatccttcaccaagaaataatatatggattaaaaaaaatccgtggtttgaacaagaggttgtgccagaattaaaagagataattagtaagattttatcggattagtttgaagataatttggaggagatttgtagcagtgcttagtaaaaaagaaataagaaaaatgaccttggataaactaaaattatatgattaccatagcaagattactgaagaagagcgattacaggcaattctgttttctaaggcatattggaataactctaattcagtggctgtaactataagtatggaacacgaattgagtactgatgtcattattcaggaggcattgagaagccataagaaagtagtagtacctagggtgagtagtggaaaattattatggtttgactatatagaaagtttaatgagtaaatcaaaattcggaattctagaaccaacacaagatgaaaatcaagcacaaaatttgaagggaatagatctaatggtggttcccggtgtagcctttagcgaagataattatcggataggttacggtgcaggtttctttgacgcaacgttggcagagtataatggtataacggtttcgctagtgttgcctcctcaatcaatccataaattttcaaaggatacgtgggatagaccggtgaggtatcttataaaataggatttatgctaaataaacttataatgaatatgttagtttttcattatgagtttatttttttaattactttatgttaaacaatctcatttaggtaattatgattattctaaaattctgtgttagctcctctcaaatagatatttctagtagcccagtctattgcttagaagtcaataaattggaccatttttattcagttaattaggcgacatttgagatacgactgcgattataaaaattgatataccaaccaatggctgcttggacctcagttaatgtttggtatgccttcaaataaacttcttcacgcttcaatattgaatgaaacgcttccatacagtcattatcgtatggatgtcctttgagtgaatatgaatgtttcaagccataattttgacccttggtattaaattcagcactcgtgtatgtgaccccatatccgaatgaactattagtggcttttgatgattatctaacgccatctgtaaggcacttgtagctagttcggctgtccttgtattgccaattttatagcctaatacttttctcttctcaggatccaaaacggttgctaaataggcccatctgtgattagtcaactgaatataagtgatatctgtttgccaaataccgctcaaatcatgctagtgcctaatcagattagttttttgagaaaccgtcacaacggttttgtgtttgcgataacgtttttgcatgcttgatctaatccttaattcacgcatcaatttgagtgtcatatactcagatattttcgggcagtcggttagttgactataagtagcaatacgacgatagccataaaatttaaaggttttccaaacgtccaaaatataaggttttaggcattctctacgcttttcttgtcgactgaactgccaatggtgccagttgtaataggtactaggtctgattttaagtggacttaaaatacgcacaagcgcgtagccttgtgctaaaaattgattaactagcggcaatcccacattacgaactattttttgactagtcaaatatccgctcgctgcctgtcaggctatgcgtgataaaatttcgttttcttcctccaaaatagtgaggcgcttctctagttccttgacgtattttaaagtctttgactgacccttgatcaagattggagtagcttgtttaacccaaatatccatagaatcgttcgacggtccgaatccttctgctagtgatttaagtgaacggccttcttggtgaagtttaaccaagaaatctttgacatcttgtgaataacggactgaataaaaatagtccattttttagtatattagcatcggattatgccctagaaataaagcagtcctgattttcagtatacgagcattgtaaatctaggtaaaattggttgattataataaagtgtgagtctggtataagcgtttgtccatgttactgaactgatatcatatatgcatatcaattggaagacgtatatttttgtcatctgccattaatttaatataactaatcttgaataaacaattttttaatgtattgtactgttctaacagaaatattgaaagcttctgctgtagattttattgtgtgcgtttgagaatactcaaagatagctgtgtttcggctatctttttttcttttgggtctaccttctttatagttgggattgtgttgccttgcaaatatcttaccagcctgcgtacgttcgataatcatgtcgcgttccatttccgcaaccgaaagtaatgttcttacaatcatgcgacccattggggtattgtcaattgttcctaagtttagaactttaatcacaattttttgtttcagaagatcatcaattaaatttaatgcttcacgtgtatttcgagcaaagcgatctaacttggtgacgatcaatgtgtcattaggttcaattagattgacaagttttttaaactgtggtcgtgatgtagttgtacctgaatatttttcactgaaaatcatttcagccccggcatttttcaaagtctctttttgttcatataaagattgtccagctgttgaaacccgtgcataaccataaactgtcattttatacctctttaaaattgcataactaagttgcagtatataaagccaagtatagcatgactttgaaaaagcgcaaaatacttaaaagtttattgcactaataactgtaaagctgtcatatttttttgtgaagattaggttatgatataattttatttgcaagcaagttaaggagtggtggaatctgatagttgggggtgatgcttattgttgaaactcaaggctacctgaaaggataacaccaaatggtctgttagaccgcggtaattgtgttgatcacatttctggttgttttagctacgaaagtagtcgaactactaaaagaaattaaaaagtctaaaaaataggtaaacaaaaaccccttaactttggccggttctaggggttttcgtgaaatgactattttagtttattaacaaaataacaactaccaacgctgaagcacgcttgtgacttaaaaggtcatgtacctaacatgggtctttttgtttatatttatactataccactttcactgtttttgccaattatttctatttcatagatcattttgcttgtttttatttagcatttttaaactaattttcaggtgtgttgtttaataatccattaatactaaatggggttagtaatgaaatggtcgtactaagcgatacttcatcgggtgtatggcgttcttgatatattaagtatacgaaattcggaatcttatttgatattgttgactcaacgtatatacgttgcttaagggcggtattgtcatcagaaagcgttatatttgcaatttttggtgctaagttattttcaatgttatctattttgtagccattttccgcaagaatcatttttaaaaaaaaacgaattccttacttgcaatgcagtctttgtttgataggtttgaataacattttgtgttttcaaattgtactgaactgatcataattatctcttttctattttcatgtagtatcccaatttaggttggtataacgtgcattttagatacatgatgatatcagtaaattattttccacatctgtaatttttacttttgaagagacactataaaatataaatatttgatttttatactttttaaagtgttaacaagtattgtttaggagaaaacatgaaatatttaaaagatagtaccctgctgactagttgtcttgtagtattttttggtgggtcattaggtagcttgttcaggctactaattaccgaaattccacatattgggagtagtccttgggttatagtagtcatcaatgttttaggatcattcttccttgcttatatcggagcagtcattcctgacagctatgactattctttaattttaaaaaattttatagggacgggtatcatgggtggctttacaacattcagcacatttatacttcaaattaatcaattaggtagagaaaattttttaattagtattatttatacattaattagttttatactggcttacattgcagttgtttttgggaaaaatgtaggaaaaaatcggagattaaatcagtgaatttttttaacttttatttgtatttctgtttagctgctgggctaggtgctgttattcgatatctagttataagttttatgccaaggattacaaattttttcacaggtgttttttatgttaatattattggtgcttttttgatgggtgtattatcagttaatatgaacagcaacgtctggcatattattattggaacgggttttattggcggcttgacgacattcagcaccatgatgacacagggagagcagtttaatagttttaaacggagtatggtatattttgcattgacattagtcttaggaatttttttatttattgtagctatacacatacacgtttaacgaaatactttgaatgtgaaacacgcagttttaaatgtctttgatgttttgttaatacatacacaaaacgaattcgcttgattctgttttaatcaaagaatgagaatatataaagaaaatcgttaaattttcctgtatttggaatcaaccccctttttgttgtaaactgattttatgtttaaaaaaagaattagactcaatacatcaaagctgtcagtagtattatatggcacacttataggttttttaacaggaatagttgttagtgtcttccgctggacaattgaaaaattgcttcaatttgtgcaaacgctgtatctcgatatttcacatggcaatatagcgttaatatttttagtgataactgctaatttaatttgttttttaattgtttcatggatgttaaacaaagaacctaatatatccggttccggcattccacaggttgaaggtctattattgggtgaactaaaaataaactggtggtcgacattgtggcggaaatttatatcaggaattttggctattggtagtggtttaatgctggggcgggaaggtccttcaattcaactgggtgcatcaattggtcagggtgtggcatcatataaacgtcttagtcataatcaatcgaaagggcttatagccagtggtgccgctgcaggtttatcatctgcatttaatgcacctttagccggcgttatgtttgtattggaggaagtctatcacagtatttctccctttgtctgggttggtgcattgacaggcgcaagcgtttcggattttgtctctacggttttgtttggccaaacaccagttttatctattggacacttaagcgttttcccggtacagttatatggtttattgttggtatttggtattatattaggcttatttggctttttatatcaaaaatttttactattcagcttaaattgttacagtaaaattagggttcctaaatatttatacggtatcgtgccgtttatcttggtgataccgattggaattttatggccaaatcttttaggtgggggaaataatttaattttatcactgaaagaagcacctatgacaatgaaaatgatcatcgtaattttgttaattcgatttgttttctcaatgattagttacggttccggtctgccagggggaatatttttacctattttgactctaggtgcactaagtggcgcattgatggctcatatatttgtctatttacatctcatgagtgcaaattatgctttaaactttattgtgatcggtatggcaggttatttcgcatgtattggtaaggcaccatttactgcaattattcttatctttgagatggttgggagtgtgacccacattttacctttagcacttgtaagtttagtagcctacttagtagttgatctattaaatggtgcaccaatatatgaatctttattagaacgtttgttgaaaagaaaaccagcgcatttagcgacgtcctccatgataactatggaagtcactgttcttgctggtggtatgctagaagatcaacaaataagagacttacaactggaatcaaatagtttgattacactggtcagaagatctgaaaatgtactgattcccaaaggagacttagtattacgtgctggtgatattatttatattagaatgaaccaaaaagatgcaaaaattactagaaatcaactatcacttaacaactaaataaatttcaaaaacacgattttagagtttttgcgtcgaaaagataaattcgttatcaattaaattacaattacagaaataattaccaggagattcttttttacaaataattggaaccagctttagtttcaaattcaattgagataacatcactttatcgtaatttagagtgttttgattgagtgagcacatcgtaatagtgaaattatattcaacataattgtatcaaaataaaaatttgcctaagaagagatggagtatgatgatataaaaattagttttgtactaaccatcagctttttttggtgtaagttctttgtttaaacaatttctatatattccttttttgctaataaaaaatcatatttttttaattagagacagaaaatgtctttttaaaaattatatcgtaggatcaggacaataatatatagcgaaatttgatttgaataataaaactatggtatatttaacttaatttaatttaaacggttgggcgcaagcttcaagaattgttagtcggggaactagcattttttggagctttttaaatattaggagaaataatggaatatctattaatcatgttcttagtcatagttactatttttctgggaaaggtaggcacctggtttggtttttctgaagttgttgggcaactattttcaggtatcattttaggatccagcatatttaatatagtacagtcaagtaatttaatccacttgatagctgagataggtatttttttactgatgttaaattcgggactagagtcggatttaaaggaaatgaaaagatacattaaagcatcgtcactcattgcagttatgggggtactactacccttaattactttcccgattgcatttttattgcttggatataatatacagacttccatatttgccggtgttgtgttctctgcaacttcaatctctataacgttagctgtactatcggaacaaaaaaaattagccactgcaataggagcaatcatactttcggcggctgtaatagatgacataattgctttgtttgcggtgactttattttctgttttagtaggtggaggtgcactggggataaacagtattttaccattactcgcttttgcgttaggtatactactcaggaagtataatttttctgataaaattggtgttatcagtacgaaaatgggtaattctttcttttaccctgtatttttcgggtccatcggtcttgaaatcgtaatccagggactgggagataagataacagctattataatttttagtattttagctattgtcacaaaatttgttggctcgttatggggagcaaaaatttctggtctagataccagagtttcaagtgcaattggggcaggcatgatttctagaggtgagatggcccttgtgattattcaaataggtatatcatcacatattattgatgattatacttcagcggagtttattgttgctgtcatcgtttcaacaatagtagctccgataatcatgaaaccactgttcaaaaagatttgatattacaattataaaagttgctatattagcagatggctgattggtttctgtcaggttatgcgttataaaatttcattttgctacttaaatagggttccaagccaataagtgaaggccattgtgagcactcctgtgaatatgttgcgcaaaatagctggaattattggtgctcgtcccgcccaagcgcttagccaaccagttaaaaaaagtgcccaaagcgttgccaaaattgttcctataactttcagattgtcgggtagtaatatcacggatagtaatggccagataccactctcatttgaggtacttcttttttgttagttgattgtactaggttcatgtactttggtcagtaattacggtataatgtaattactaagatttttgggaggtcaacattcttatggttacattatttttatcaccgagttgtacctcatgcagaaaagcgaagcagtggttggaagaacacaatatttcctaccttgaaagaaatttaagtaaagaaccattacgagcagaagaagtgagtaaaatgttgcgcttaactgaagatggtacggatgaaataatttctagacgttcaaaagtttttgcaaatttagatatgtgtttagaggatcttactataaatgggttgattaagttgattgtggaatatccttcattacttaagcgaccaataattattgatgatcggcgcatgcaagtgggttacaatgaggatgaaattcgtcgctttttgccacggactgtgcggcagcgcgaattaattcgtgcaacatataaggctgactttgaggaagaagcgaagaacttagttgttgaagaagtatgagatttttttgaatgaaatatcagctctgatctataaattttgaaaggaatattaatatggaaaaggaaagaattaatgaaaatacaatccgtgttatgattgataattctgatttaaaagatcgtggaattactgtaatggaattattaggtaatcatgaaaaaatcgaatcttttttttataatattttgtctgaagtagatactgagcatgattttgaagatgatgatcaagtttcgtttcaaattttaccaaaccgcaatggattggaattattcatttcacgactagatgaagaaaacaaaatttctgacatattagataatattactaatttttctagtaagcaaccggcaaatattgataatatttctgacaagagacgtcaagaattgcgtcaatcagataaaggagatattgtgaaatcaaaagtatcttcaagtgatcataaagatggttctcaagagaactttgaaaatacgcaagtaatattggcgttatcagattttgagaatgctattgctattgcgaatagccttaaaatcgaaaatttagtctctgacctatatttgtatgagggtgcgtattatttaaatctattagttccggatcattctgtcagtcaagaacaattaaaaaatgaattggcaattgctttagaattttctcgtatcagccatgttacacatgaggttctgcatgaacatggacaacttatattgaagcatgaggcacttgaaaaaattaaaagtttattttcttaaacgctacaaagcgttttttttttggtacaattaaataagattatttaagaggttaaagaggaaaaatatgaataacatattattattggtagcgacaattgcatttgcatggattctgttttcatttgctggttggctttgggtgtttgtctcggcaaaaatgcatgggacattgttaaagcccattgaatttactgaaaaactagaagcagataatggtcaaattattgacgtacgtgaaagtacgttgtataaacgatcacacattttaggatctcgaaacattgttgctatgaattttttgcagggaaaatctggtttgcgtaaagatcgcgatatttttttatacgatgataaccttcgtgacgctgtgcgagctgctaaatcattaagcaaacaaggttttgaaaaagataaggttttcatattacgaggtggttttaatcgttatgaaggtaaaaagacaaaataaaagaactgcaatagtgcggttctttttcttagtatcgtgattgatgtgcagcaacgcttcttctgatagctgctttagagacttcattgtactcttcttctgccttttcaataggcttgataaccttgtgacgatatactaaagcacttccagcaactgcagcagctgttccaaaagttccaatgataacacctaatttaaatgatttcatattttttccactttcttaagtttctttaagtactattatcaaccatttcagcgcatttgtaaataactatgattgggtaaaacatgacagaaataatagcacaccgcggatatcgagtagttgctccagagaacacactacctgcttttgaggcagccttggcatatgatattgatatgcttgaaactgatatacatcgtactaaagatgggcatcttgtagttatccatgatgaaacagtagatcgaacaaccaatgggactggtttagtaaaggaactaactctagcagaaataaaaatgttggacgcaggcagttataaacagccaatgatgaataatgtttcaatcccaacactagaagaattattaatttttttaaaaaatgaaaagtttagtaaaacgctacttttagaaataaaaacagatcatattgactatccaggcattgagcaagaagttctaaatttagtgaatcagtttgatccgacatatcgtattacttatcaaagcttcaatttaaaatcattaaaaataatacggaagcttcaacctaatgctaaaatcgctgcactagtattctggccttcgcccaaagtttggtggttaaaaattattggtgtatttaaatttgtacatcctgatattagaatactaaaaagaaagccaaaattattttggcgtataggattgcccattcgcccttggacggttgacaaggaagaagatatgcgcgctgtattcaaagcaaaattaccaggaatcatcacaaatcaagtagcgttggcctgtcgaatacgtaaggagatacaaaaagttaatgaataaaatagtagtgttgactgggccaacagcctctgggaaaagcagcttatctattcagatggcacaacgtctcaacggtgaaattgtatcagctgattcgatgcaaatttatcgcaacttggacgtcggaactgccaaagtgactaaagaggaacaaaacattgttccgcatcatttaattgacattgtagatttaacagataattactctgtgggcgattttattattgctgcagataaagtgatcgctgatatcatttcacgaggaaaattaccaattattgtgggtggcactgggttatacgttaaagctttgttaggctttcaagaactagaatacgccgcaagcgatacggaagaagtgcataaattaaatgcttatgaactagacaaattagttgttgaattaaaatctttagatattaatcgtgctcaaaaagtagatttaaaaaacaagcaacgcgttattagggcaattcaaattgcaaaatatgggaaaaaagatgcaaaattaacacaacggccaaagtatgatgcgttggttataggccttgattggccccgtgagctactttatgaacgtatcaataaccgtgttacacaaatggttcaagatggcgtgttgaaggaagcacagacaattctggacgctggtggggaaaaactacaatcagggaaggccatcggttataaggagtttttcccttacttacgcgatcaggtaactttggataaagctattaatcaactgcaacaagattctaggcggtacgcaaagcgacaattaacctatttgcgtcatcaaatacctggattagtctggctaaaaggacagacggctgaacttaggttaacagagatgattgaaggctggttatcattgaagtaatattggtatttgtaagcaaaaaaagaacacgtctgtgttctttttttaatgatataacaataacattgagaaagcttgtaataagatatagcccatattctgccaattacccaacttagccttcataaactgtagtacaaaagccaataagctaaaaagtacaacaaagatagtgctgataccaacatgatggctgaacaatacaacccagaatagaccaagtgttaaaatactcaatttcctaccatcgggatttggcattaagatgggattgaaatagaaaataaagctgaaaaacatgggtaataattgcaaaataaatttctcggttacaaaattattttgtacataaaaaatagcaataggcactgtgaacgtcgctagaacggccagtaaaattaatcctagaatattttgtaaaccaagccagagttgttgaacgatgactaagaagacacataagagtaataataggacgaatatttcatgtcttgattgaattaatgaactaaatgtgaacaagctaccaacagcaaaaaaaatataactaatcagactacggaagttctgagtcatcataagcgccatacccactgctattgctattgtatagcaaaataatggtgcaatttgccaagtaatggaaccttgaagagattgggtatggagtaggggtaatcgccaccaaataatatttagagaaatcacgattacagacagtggtatccaaaaacggcggtcacgaaaatgtatcggataaaaattttcaaaacttcgtttgtcttgagcatcattgcttaagcgtcggggcattgaacggccatctggcaggcgatgggccatatttgattgttgaaaataatcttgttccatgactaatattgtaccgtaaatttgaattgtaaagttgtcgttttgataacgacatagttacagatgaaatattttaaacgttatttgctttttaatgaaccatttgatatgattgtctatacaatttaaaacagctatcaagagtaggcgagtgatacagcacaatgaccctgcaccaaccggcaaaataacgaaaagcagctacgagagtgtattttcatcagttttgacatggtggtccatctgtacagatagtcgtcacgttagcgcgttcgactatgcttgtcgaacgcgcttttttatgcgactcttagctttttattttgattcaaaggtgacgaccaaacgtaggagagtattcatggcaaagtatttcacatcggaatcagtttctgctgggcatccagataagatagctgatcaaatagctgatgctattttagatgcagttctcgaacaagatccgaaagcacgttcagcggttgaagtgactacttcaacaggagatgtatccatttttggtgaattatccacgaatgcttatgttaatattcgcaaaatcgcgacagatacaattcgtgaaattggatataatcatgctgaactaggatttactgccgattcagttaacgtttctaataaaattgttgagcaatcaggggatattgcacaagctgtcgataatgcagaagatgatccagaccaacttggagctggtgatcaaggtatggtatttggctatgctactaacgaaacagacagttatttaccattgacgttggctttgtcgcatcgtttaatgcgcaagattcgtgatgcacgtgaaaacgaaattttaccatatctaagaccagatgctaaaggtgaagtaacagttgaattagatgataatgataaagttaagcgcatcgctgctgtggtcctttcaacacaacatgatgacgaagtcacactagagcaattgcgagctgatattcgtaaacatgtcattgatgaagtattaccacaagatttggtagacgaagacacgatttattatattaatccatctggaagatttgttttaggtgggccacaagccgattcaggattaacaggacgtaaaattattgtggacacttatggtggtgctgcccatcatggtggcggtgccttttcaggtaaagacgctacaaaagtggatcgttctgccgcttactatgctcgttatgttgcaaaaaacatggttgcggctggggtcgctgataagttggaattgcaagtatcatatgcaattggtgttgcacgccctgtatcactgaatgttgattcatttggtacagccaaagtttctgaagaaaaaatcaatgaaattataactaaattgtttgacttcagaccattagctattattaacaacttaaatttgcgtcgtccaatctataagcagacagctgcattcggacatttcggacgtacggatatcgatcttccttgggaatcattagataaggtgaaagaaatcaaaaacttactttaattcatgataaaatgaaatatggttaaaaaaggatcgacaattcaatttttgttgaaaggaatggctgtaggcgaaagtattgcctatttgccagttcgtgaacaggaaaaattgttacgaggtgagtcagatcatgagctgagatggggtacccagacaagcttggcactgacaacaaccgctagtttatcacgaggttatcagttagcagatgtaatgattcatctgcaaaactggtacaaaaagcgccaatatgcaccaatgggaacaattcaagatgtggatgttgtgaccaagcaggcgttagaaaactatactaaaaatagagacatattggcagcaggaattggtactgatgatgctgatagtgaaaatatactatcacgtatgctgccagtatctctctatttatatcatcaagtaggggtttcttttattaatgatgaaccagccatgctgatgttacatagaatagcgggtttaacgcacaatgacgagggagctctggtcagtgtgggggtgctcagccttattgtcagtcaaatattggacgggcatttgatatctgatgccgtagaaaatggattagcatttggatttgagtattattctcgccaccaagtttttgtgaatgaactgactgcgttttatgatctcaatctacctgatttttcaaatataccagctgataaaatcgaattaaatggtaaagcttcgccaacattggaggcggttatttggagcttgttgaatagtgatagttacacgcaagcagttgaaaaatctttgattcatggtcattctaacagcattgtacccaccctagttagtgcaattgcagcaatatattataaagatgatttagtattagaatttggacaaaatcttgtttcaaaacgtgtgattacgacggtaattgggcaagctgaacgttcatcaagattcaatctattaaataaacccactaacttaggttagtgggtttattttgcaatttaaatccaaaatgggtaagactgttgatcaacattaaatgaaaaactaccatttccaagtagtccgccatcaatatgtccaggttgaatatcgtgaacatgaatagcatctccaggggataggttaacgtgatgtatgatgtttgatcttaaatatttatgattgaaaataatacccgtgacaaattgcatcatcttcattttcctaagaacaataatttctatcgaagtttctggcaggttgccagtagtagatgttgcagttgctttgttttttaaggttagtaggaaggagtttggtagttgcaaatattccgagcaagcgttaatcgttacaggaaaacttttctgattaaagaaggctttagttgtcaaaaaatgattttttaatatgttaagtttgaatggactggtatttttaatactatttttcttgtattcggtgagtgcagtatcaaaaccaatgccaacactactaataaaatatttagtctgctgtttgggtatatcaccacagattttgccaatatttaaaaatttaggatgatgaatttgctgtaattgaggtaagatattcgtcttatctttgagatagagcgcgggtgtgaaattagtatggagatccaaaggtatataactaataggaagttgatgttggcgctcgacactaagtagtccatttaatactgcattcaaggtgttgtcgttgccaagtactaaaataacatgatttgatgattcatccggtaggtttttggccagtttttttgctataaaagttatttctgcgtcaaatgtagcctcatgccacgaaacaaattttagtgaatttttcacgtgagagacaaaatctgcagattgtatatcttggtgtttatcttgtactatattaataatgtggaaatctggcatattttgactcttgctttcaaacaaattagtatcattgtatcaaaatttcaatgttaaggcgaactgagagcaaataaaaaaagcctgtttaggctttttatccgaggaagtgtcgtaattgtgccatgcggttaataagggctgtaatggcaactggagcaccatctttaaattgcactacttgaagtgctatttcagcatgttgttgttcttcgcgcgtttgaggaccaatttcaaacttgaaaatacgttgcatgatgagaatatcttcttcaacttcggcccaagcagcattttgagtttttagaatttgcaaagcatccatattaacgaagcgtgctaattcattaaagtctttgctcatgctaggatatgagcgaacaaatacgctcaaatgatcagcatctaaatgcttcaatgcgcgcccaaaaccaataaattctggtgggacaccgactgagtagaatgagccagtgaagttaatggcccttggtaattcgatgccatcaactgaacgtgaatatccaagaacaccaacgtgttgacggcgatcacgacgctttgggaacgccttgaaaatcgcttgcatgctaggaaccaaattgtctagcgtattagaataaaacttagcggactcttcagctatctcagttaaaatcttttgatcatcaagagaaatttttaatggttctgcaaccggcaatttttcttttaattcagcgatgcctttttgcacttcttcaataggaaagtcgtaacggaatgctgattgaacagttgctgtgcgtacccctggaaattctgttacgtagcgatcgatgcggtgtggagataaaccaccacggaaaattgctgatccggttcctgaaattgggaaaatttcaatgttttcttcttcagcaaactcatgaagtcgcgcaattgctagtttgttaccggtaattgaactcataaatccagctgttaaagcagaatccgatccggctaagaatacacgcatatattttggtcggaagccaaaatgttcttcgtggaggtttaaatactcctttaaaatttcaggtgcatgtaattgcgtttcaaaatcctcaaaaagagggatcatttcaatatagggtgtgtttttatcagagcgagtaaattctgctgatttgaaatttgctaatttttcaaacaaaacttgcattttcaaaatttggtctgcacgctgtgccattggcagaatagcttcaaataatggtcgagagaatccaagatcatgggcgaagtcttcagaacttaagaaggcggtcatcgcttgcattaagttgtagcctttttcttcccaaatattagggaaacggaaagttaaaaacttgtcacgaccgatttgatgatctttgaaataatcatactctgtgctaaacaagcgatcaatgacagctgcatcagcatgtttaccttcccaatcccacatatactcatcgacatttaattcattaaagttttcaaatgcttcaccggtttctcgataggcactgataaatggttgctgagaactttcccagaatggcgcattagcattatctggatgttgcgttcccatgattgaagggattttacgtgatgtcatgatagctccttaatttgtactgatgatattgtaacatactgacaaacgacaagcagaaataatgtcagcttttttacgaataattaagttaaatgatccctaatgttcgaatattgcggggataaatttctgatacaaattaatcatagtatttttgagaaacattcatcttgataagtaacctaacatttgtttgaataattgttaaagtagtggctatactaaaatagtaatgtttgttcacaacattactacccccaacagacgattgaaattaaattcctcgatatagtcctgtctgttggggctttttttattattaaaattgtattatgaaagtacatatttttttctgaaaaatatgttgacaactaataattaatacattataatttaatcattgtttatttcattgctccatagttcagtggtagaataacgcactgttaatgcgcaggtccttggttcgaatccaagtggagcagttagtaaaaagccaactcacaatttgttgagttggcttttctggtcatttgaggtggtttatatatcataaatgtaagcgtttgcaattggagcatttatatgctatactatgtgtatagattaggaggaagtcctaataacaatgcgagttgttgaagttatccttaacgataacgggaatgggtttctttcaatccaggagcagtttactcagcgtttaggctagaaatgttgatggtgcctgatagctctatttcagcagatgcttagatgagaaaataataatttacccagtgtaagctttggaaattgttgtttgagagtaagctgctttttatattgtcaacatattctagcttgattctctaaattaactttttccaaaaagagtgttatcattgattgatgatgagagaaaagggggaaatcatatgattaatgcttatcgtgaattttggacaaaaatgttttcttggcatgcaacggcaacaaggacacagtactgggtaccgttaattgtcaattattttttgggtggaatattagttagcatcttggaaaatatgcaaggtcattcaattgaagatatctacactgttggtgacttgtctactaatttgacaacaagaatcgtcatgataattgtgtggattgctacttttactttgaaagcacgccgtctgcacgatacaaatcgaagtgctggttggatatttattgatttgattccgattatcggaaatatttggttctttattttaatgattttaccaacgacaccggaatcacgctggactttgaatcaaagtaatgtgaattagtaataatttgtgaaataaaaaaacacctagattattttctagatgtttttttatatagcctgttataccaaaatgctattttggacaggctctgcgaggcgcgtcatcgacaagcgatgacagtagcgtttccccttccgactggggaaagggctattttacaacgccacttatctggcttgtaaaacctccggcgggtcacgccgtgacagggcaatttatcattgcaagatcaccttcagcgggagcatgtcatgcagaacgctacccgcgtggggcaagctgatgtcagcttaaccacataaaaaataagttgagatagcatcggtgtctatcccaacttattttgaatgctaatataatttctcatcgtattaagttatgaccaatattccctgtaagcaaactacacgcgtttttttggtaacaattttaataaatctacactggtatggattgctcagaagtcaataaattggactatttttatttgccacttattattttgataagtctaactattgcttttggcataaaaagtgtcttagcgatactggtactaattattctgtcacttacattagcattatttattgcaaaataaaaaagcaaagcttttataaaaaagtcttgacattttatttttcccaaatcatatgatactcttttgaatcagtctcagtatccatacctacactgtctatgataaaatctttattctcataaaaattaacggcattaatattatctacatagactgaaagtgttaatttgtcgttaatttgttttaggtaattaattaatcggctaccaacaccttggtttctgtagttcatgtcaacaaataatccagctatgtaaccatctaattcgcctaaaaaaccgataattgtttcattattcctatacacaaaaatatttgcttcaggcaacatttttttaatgttcacaaattgatttttccaatactgagcgggaataaatgaatgtgcttgtaaattgccattcaaccaaatctgtgccaattgttctaagtccctatctgaaaaactgtttaattttgtaatcattgtagccccctttttcctaaaacaagtttaacaaaaaataggagaggattcgattatctaaaactaggaaatgatattaattaatcatatactttcattttacggactgaataaaaatagtccattttttagtataagatcaattccttatgagttctgaaagatactagatttatagtatactatgccaaaaggaggagttagatgaacaatcaaatcacactagcgtatttagattatgatgatctagatgctttacaagttgtaagtgttgtcactttttatgaatcgtttatcgatggcgcagatccacttgatatgcaagtatatttacagacacaattgacaactgaaatattggcagtagaattggcacagccaaccagtaaatttattggtattaaggatcatcaaatactcattggttatatgaaagtcaatgatgaaaaagatgctatagagattcaacggatctatctgctcaaagattatcaaaacaaagggttagggcaacagttactcgatgaagcgaatcgttatgctaaaacgaaacaaaaacgttatttacgtttgactgtttatgaaaaaaattatgcaggtattcgtttttatgaacgtcatggatttaaaaaaatcgggatcaaacattttcctttaggaaaacaagatcgtatttgtccgattttagaaaaagaaatctaaaaaaacgtcctcacttttgatgctgaggacgttttttttcttgtgttaatccttttgactttctaattagtgtaatacgcgtttcgtgactcatacatttttctctctttcactaatgattttataaataatcatagatatatgctaaaagagttaacacgtcagtagtccgacaattaggcgacaggttactgacaatacttagttatcatgcagaattctacccgtctgggacaatctcgagacggtttaaccacaataattaatttttgaagtttctgatgaattcaacaatatagtcactaaaacttattattgaaaatccaagcaagagacctaacatagataactcatttgataaaaagatcatactaggcacaataaagaaagcgccaatcaaaataacaatattttgtaaattatacttgataagagagttagatcgaggtgtgtatttttgttcatcgcgcataagttcatcgagtggaatattaaatagattggaaatcataatgatattttctttgtcagggtaacttttattcctttcccaatttgatatagcttgataggaaacgtgtaaagaattagctaagtcagattgcgacattttgttagattgacgtaaatgttttattttttcacctaattgcatatgatcaactcccattgcttatatatttaatacataggttagcaaattttagcttgatcagtcactaaagtattacttgagtctaattaaggcatgagtttacccaaaatcaatttgatctaacatggtttcacgacttgcttgatctaaaccaagataagtcagcgtcatagcctcactagaatgatttaataaatgcatgactagaccaatgttgtaatttgattgagtataaacacgataggcgcctgttttacgcatggtatgtgtgcctagatagttaatgcttagtagatcgccaacacgcgccatcactttataaaactgtttctcggtgatatgtcgatcaggatgggctgtcgaggggaataaccaatcagaattgatattttcttgaaccagccaatcatgatattgcaacaagtcttgctgaacaggctttaaatataacgtgtttgctttaccggtctttttatcatgaataaaggctgtatttttgacagagccgtctggattatagacatctgatttttttaatgtcatgacatcactcacacgtagtagcgtggccttaccaacttgaaaaacggtgtaatttcggcgaccagcacggaaactatcgagaagtgtatcttgtaccatctttaaaacgttggagtctttgatgggtaggacaatttgttgcgccatgattcatatatacctttctgaaattaaataattaaattgtttatttattgatgaccaggaccgtatttctaaacttcttttatggtttattatatcacttaacaaaaaaacaacccccattatctaaccggtagataatgggggttgttttaatagggttcatcaggggtgattatataattttagaccattagtttttgaatatattggcgaacttgtcttgaatcaccataaaaataaaatttaaccccatacaatttagcttgattattttcacctatcacatcaactcttccactgatcttggtcaagtaattgggtacctctaggttcaatataaacctgataaatataagacaaagtccggtaagaaaccgacatagtgtgacacctctccagaaaatcgatgcattttcagtttagtattgcgctcatcactacggatgaggtaaacatctttatgtttatttttcagttcttcaatataactttgtagacaaaccagggtgttttttaatagtcataagtttgaattaactcatgaacaccagcatagttaactggtacacgcttttgatagtccggaacagtttctttaattgttaatccaataaatttatttgtcccacattggcgcttattgggtgtgccttcaaacttgtgaaattcattcaaaataccagtcctctggccggaaaaggggtaaacccacaaaaaaatctgggaacgagcccgaaaggggtcgaaaaagtggtccggattcctgacataaaagcctaatgcattatttaaagaatacataatcctaaatatccaagaaaatatcaaatacgctttgtggtaattcaaaatctagttgcttggttttgcgcttatttaggctttgtcggcggagcaaggcttgttgctttgaaatactctttttctcaccagagacggcggcattctttcgaattggaggaatatcgacacgggcaatgacttttccttcaacgatggcttgtgccggcattggatacaattggcgtggcacggtgtactttagcttgtggacgatctcttgggactgatccgcagcgttggtccggtttgtaatgaacgtcaattgcggtacattactgtaattaatatcaaaagttattttcactatatctgctggctgataagtgatctcacccatcgccaacgtcgcgtaaccatgggtttctgacttcaatgcgttgaaaaaatggtacgcgatttcagataacggcatgttataggttaactggactaagttactaaggttgttcaggtcaatcaagacaccccggtacttctctgataagttaatcacctgattaacggattcgggaagtgtagtgatggtcatcgtaacgatgggttcttctacataatcgatgtccgaataatttggaaaattgactggattattgactgaaacgtccttgtcattcttcaaatgtactttgtaagtcacattgggtgaagtcgtaattacttccatcccatactctaccagtaggcgttctttgataatctgcaaatggaaattacctaagaagcccactcgaaagccctgacccagcgcatcggagtaatcattttcgatcttcaaagacgagtcatttaacgcgattttaaataacgctgacttcatctctagaaaatcgtccttcgggaaaatgcccgcatatactacggaagtcgcctcctcataaccaggtagtggatctgcggtaccggcaaccgcggtcgtaatcgtatcacccacacgaatttggttcacttctttgataccagtcaccacatagccaacttcaccagcatgcagcgtgtcttgcccgaccatattcggattgaagattccaattgatttggcatcaaattttttgcaagcattcatcaatatgagcttctggttggctttgatctcaccagccactaagcgaatatgggcaatgacgccttgatagctatcataggtcatatcgaacacgagcgcttttagttcttgggcttggtcagctaatgtcggtgcgggaatgttgaccacgatggcttccagtaattcagtcaccccggtaccgtttttcgaagaaatctccaggatatctgccggcttaaattgactatctaaatccaaaatttgctgtttaacattcgctatttcagcattgggactgtcgattttattaatcaccggcatgattttaatgtgctgggctttagctaaattataattcgcaatagtttgcgcttgcaccccttgcgtagcatcaaccaataaaatcacaccttctgtcgcagacagactctttgttacttcatatgaaaaatcaacgtgacctggtgtatcaatcaagttcagtacgtattgccgattgtctttggcaagataataattggtgaccgtttgggatttaaccgtcacaccgtgttctttttcgaccgtcatattatctaacaattggggcttagaagtcctgtcatccaccgtgttggtgaactccataatacggtctgctaaagtcgacttaccgtgatcaatgtgggcaatgatcgaaaaatttctaatattgtttgaatctatattcataattctgttctccatttcgtttaattgaaactaagcgaaaaagaacgtcattttttagacgtccttttaacggacgccaccaatcaacataatcattatgtctctccttactaattttacatatatacgtatccataatatgactatagaccctataaagtcgtggtttacgaatcaaaaatataaatacctaactgcttctctaacctttgtatatgttttttcggaacttttttattgtggctcatatacaataactttttttaacttcatacctgaataattcaaccgtttcaccagatataaaataaatattcccaaagtctttcaaaatagactgggttgtctccataatttttgaatcaatcatttttttgtactcttttgctaaatggccaccactttttatttttcttttggggcgattcttgtatattgtcttctgtagtttcttttggggaaacattatctctttctatatcttgagatggattattcaatgcttttaaagcctttatttctgatttatattcttccagtattttcttatcttgcaaagctaaccgttgttgttgatctagcaaattttgcatttgagatatctgtgaatctttattttctaattgcctatctttaacagctaattgttgttctaatatttttagtacagatacttcatcaacggttttcttactatcactggtaaagttgacaccaccgttaccaccaacgttgctatcaactttaccagaatcattaccacccgaaaaatgctgctttaaaagcatataaccagtaaatgttactaccaacgtttccactccgttactatgtacagtttctacatagttttctctaaattcctcagtcaatctttttctaactgcttgtttagacacattaaattcgtcagcaagttctcggattgtttttaaattttcactcatgatctatatcctgccttttaacgatgggtagatactgttcaatcgattttttaagatacttagcaatattctttttcgaatagtcatcttgtttgtctctgatataggctaagtgttctttcacgccctttaaaccacgtaactcttttaattcgtcataaagtggataaacatttttctgtaaccctgacaaaatagtagtatccgttaaatcaatatatgacaataaaaactgttccataagtaactttgtatatggactttttattgccttaactgtcaacatatcttctgtttcttcttgacgaatcttaccctcgatataaagaagatcatcttgtttataactactgtcatcagcaatttgttttttattaatgtgaaagacaatgctatcaatgctgcggccttttttaactttttcgtacgtcacattaaaagttgtatgatttgtaatttcttcaataccattttttaaaattcttttttcaaaatttctaaaatcctgatactcatctaccgtatctgtcatttctcgtaaatctcggatactcatttcaggattacgataactatcaatttggtcttgtcttcgaccacctttaacgctgtaatgctcgtactggttgtaattcatcgataaccaacggtataaaataattgcatacttgctattcaattctgcaatatctgacaaagcatgctgcgtaaaattggttttgagatttattaaataaggcatgatttcacgatgaaattcaattttcacttcgtcgttataatccgtccactttacatacggtataggaacaatgctttcaaattgaaatccctgactggttttttctctaatttgaaaaaaagcctgtttttgcattttttcaatcgcttgtttaaagcgactatgtttatcgttgtcattcaccttaaagaaagcaaacagctctcgttttgataaataaaccgtttgatctggaggtgggttgtctgtatcaattaaagaaacagctaattcaaacatctttaatggggttttgtccattttggcaatcgacgtgattaggctattatgttcaacgactttacgttttgataattcattcaaggtctgcacctgccttgtctttgattctggtataatagacatatagatacgctcctttaggcgtgttgttggataagcataaagaaaaacttttagccgggaatttctttatgctttttattatatcatttaacgtgtacataaaaataaaattgtacacgtatgcacagtattttgtacacgtatgcacagtattttgtacacgtatgcacagtattttgtacacgtatttaactttaaagtactgataacgctcactttctaagcgcgcaaaagaacaaaagattaaaatataaaagataaacttataataggctccgcctttttattaattcaataaaatagaaaaataaaaagaacaccgttgtacataaattttgtacgtggtgttctttttgtgttgaatcatttcaaatgccggcacctagttgtctaacatgattgccatttattaagctgatagcgacattttaatctatttgatgactatttctacgtattgcagataaaaacgcttagacgggcaaataagccgttttaacgttagagacttggtcctttaaaaagatcacgcgttaattcaatgattcgattgattaatgctttaacttgttcaataccgtgatctaatctagttggcgatattttcgtgtcttgatcttctcgtgctagcatgagggcctttaaccaggaatcggctatcttcttattttttgtaagtatgtcatgatcaagcttataaagcacatagcgtgctttaacatcacttgttttcatactgttcacaccataatcatttttaagcatatcacgcatagcataacccatctgttggtgttctcgctgccgcttctgaagcgcttcatgcgtttctttaaggttttgataatcagattggatgtcagctaattgcgctttgacttgtcctaacgcttgcttgagttcttccgtctcatgctggctttgtaaggtgtctttcttcatcgtggctaacacgtttttaaagcgatctaagtcatctggtttaatcaccgtcttaccaaagaggtttttagataaggcttgtttaaaatcatcaatttgtttttcggctaagtcaacttccgttaaggcttgatccgtgattttaagtacggcctgtttagcactaatattttcttcaacgtcagctagttcattttttaaggcgttaaactgatcgttgtattttttgatttcagcgacattctcaaacggtaaggttttgttatttaaaatgcctttttcataaaaagggagcaccttttttaaatcctgatctagatcctcatgaaaggtttgtaaatcatgtcgcgttagcacttctttagcggatactttataacgcgattttttatcatcaaaaacaacagggacaaaggcatagtgcaagtgaggggttgtctcatcataatgcacgacagcggccacggcattttcttgaccataacgtgcattaagaaaattggtagttgcttcaaaaaaggcgctctgtttctcgtggggcacttctgtgagttcttcaggtaaagtaacaatccaagtcgctaacgcctttacatcgtctcttttcatgcaataaacgtcatttaaacgtccattgaagcgtgaaagcatatctgaaccatcagacatgagatcttgattcagataggttttcgacacatcaatgtctttgttagtatgatgatcggttttacgttcaaagtgaaccgctaaaccaggtactgcgccacgcgtatttttctttaaatgcgccataaaaaatgcctcctcgaaaaaggttttccaagaccagtataacaccgttaaaaatctggtacttcttttctatgtacggcaccgcatcgtcctatcctcgcaggaagcgatcctccaactactttcggcgctatagagcttaacttctgtgttcggtatgggaacaggtgtgtcctctatgctatcgacacgacaccttgagtgttagccactcaaaactaaatagtaacaaattcttcttctatcctaaaccactcataattgcttattcgaatatttctatccgtttgactttggttaagtcctcgacctattagtactagtccgctccattgatcactcaacttccacttctagcctatctacctcatcatctctaaggggtcttactctattaaatagatgggaaatctcatctcgaggcgagtttcacacttagatgctttcagcgtttatctcatccatacatagctacccagcaatgctcctggcggaacaactggtacaccagcggtatgtccatcccggtcctctcgtactaaggacagctcctctcaaatttcctgcgcccgcgacggatagggaccgaactgtctcacgacgttctgaacccagctcgcgtaccgctttaatgggcgaacagcccaacccttgggaccgactacagccccaggatgcgatgagccgacatcgaggtgccaaacctccccgtcgatgtggactcttgggggagatgagcctgttatccccagggtagcttttatccgttgagcgatggcccttccatgcggaaccaccggatcactaagtcctactttcgtacctgctcgagttgtagctctcgcagtcaagcttgcttatgcctttacacgctacgaatgatttccaaccattctgagcaaacctttgagcgcctccgttaccttttaggaggcgaccgccccagtcaaactgcccgccagacactgtccacgatcacgttgagtgaccagtgttagaatgttcatacaacgagggtagtatcccaccgtgcgactccgactagactagcgtccaatcttctacgtctcctacctattctgtacaagcagcacaaacattcaatatcaagctacagtaaagctccatggggtctttccgtcctgtcgcgggtaacccgcatcttcacgggtatttaaatttcaccgagtccctcgttgagacagtgcccagatcgttacgcctttcgtgcgggtcggaacttacccgacaaggaatttcgctaccttaggaccgttatagttacggccgccgtttactggggcttcaattcgtaccttcgccgaagctaagcactccttttaaccttccagcaccgggcaggcgtcagcccctatacttcatcttacgattttgcagaaacctgtgtttttgataaacagtcgcctgggcctattcactgcggctcatgttttaccatgagcaccccttctcccgaagttacggggtcattttgccgagttccttaacgagggttctctcgctcaccttagtgttctccactcgactacctgtgtcggtttgcggtacgggcagtgtaatacttcctagaagcttttctcggcagtgtgacgtctcagacttctctactttatttcgatccgcatcacagcttgtccttatagaaaaaagcatttcactcttttcaagacttactgcttgcacgcacatatccatcagtgcgcatctggtagcctcctgcgtccctccatcggtaataacgcattacaactggtacaggaatctcaacctgttatccatcgactacgcttctcagcctcgccttaggtcccgactaaccctgggtggacgagccttccccaggaaaccttagtcattcggtggacaggattctcacctgtctttcgctactcataccggcattctcacttgtaagcgctccagcagtccttacgatctaccttcgtcgcccttacaacgctctcctatcgcgcacttacgtgcacccgcagtttcggtaatatgtttagccccggtacattttccgcgcaatggcactcgactagtgagctattacgcactctttaaatggtggctgcttctaagccaacatcctagttgtctatgcactatcacatcgttttccacttaacatatatttagggaccttaactggcgatctgggctgttcccctttcgacggtggatcttatcactcatcgtctgactcccattcatacatatctggcattcggagtttatcaaactttggtaacccgagatgggcccctaggcttaacagtgctctacctccagtatgcttataatgaggctagccctaaagctatttcggagagaaccagctatctccaagttcgtttggaatttcaccgctacccacagttcatccgagcattttttaacatgcaccggttcggacctccagtaagttttacctcaccttcatcctgaccatgggtaggtcacttggtttcgggtctacagcatcgtactattcgcgctattcacactcgctttcgctgcggctccggtctttccaccttaacctcgcacgataccgtaactcgccggttcattctacaaaaggcacgccatcacccattaacgggctctgacttcttgtaggcgtcgtggtttcaggaactatttcactccccttccggggtgcttttcacctttccctcacggtactggttcactatcggtcactagggagtatttagccttacgggatggtccccgcagattccgaccggatttcacgtgtccggccgtactcaggatcctgaaaagagtgtgcttcatttcgcttacggggctatcaccctctatagccaagtttcccaacttgttctgctataaaacacttttgtaactcttatatatcagtcctacaaccccaacatgcaagcacgttggtttgggctcttccccgttcgctcgccgctacttagggaatcgatttttctttctgctcctgctgctaatgagatgtttcagttcacagcgtattccgtcaaatatcctatgtattcagatacagacaactcttacgagttgggtttccccattcggaaatctttgggtcatagcgtacttaccgctcaccaaagcttatcgtagttagtcacgtccttcatcggctcctagtgccaaggcattcaccacgcgcccttattaacttaacctatacaaccgaagttgtggtttaagtttatgagttggtcatttttcagacctgcgattaaaccgttctttttaaagaactttttgtgttgtttctcggttcattttagtgcaatcttacgattgcttttaaaagaatttgttactattcagttttcaatgtacaacatgctagcctttcgactagctatggagaatagcgggatcgaaccgctgaccccctgcttgcaaagcaggtgctctcccagctgagctaattccccataggatcactttgagaccatgatacctattaaagtatcacactcaaaactaaacaaaactttgaaacaaacaaattgacacttaagtccctgtcgctttccgattatccttagaaaggaggtgatccagccgcaggttctcctacggctaccttgttacgacttcaccccagtcatctgtcctgccttagacggctccttcctaaaaggttaggccaccggctttgggcattacaaactcccatggtgtgacgggcggtgtgtacaagacccgggaacgtattcaccgcggcgtgctgatccgcgattactagcgattccgacttcatgtagtcgagttgcagactacaatccgaactgagacgtactttaagagattagctcaccctcgcgggttggcaactcgttgtatacgccattgtagcacgtgtgtagcccaggtcataaggggcatgatgatctgacgtcgtccccgccttcctccggtttgtcaccggcagtctcgctagagtgcccatctgaatgctggcaactaacaataagggttgcgctcgttgcgggacttaacccaacatctcacgacacgagctgacgacgaccatgcaccacctgtcactttgtctccgaagagaacacttctatctctaaaagcttcaaaggatgtcaagacctggtaaggttcttcgcgttgcttcgaattaaaccacatgctccaccgcttgtgcgggtccccgtcaattcctttgagtttcaaccttgcggtcgtactccccaggcggaacacttaatgcgttagcttcggcactaagaggcggaaacctcctaacacctagtgttcatcgtttacggtgtggactaccagggtatctaatcctgtttgctacccacactttcgagcctcaacgtcagttgcagtccagtaagccgccttcgccactggtgttcttccatatatctacgcattccaccgctacacatggagttccacttacctctactgcactcaagttaaccagtttccaatgccattccggagttgagctccgggctttcacatcagacttaataaaccgtctgcgctcgctttacgcccaataaatccggataacgctcgggacatacgtattaccgcggctgctggcacgtatttagccgtccctttctggtatggtaccgtcaaactaaaatcatttcctattctagctgttcttcccatacaacagtgctttacgacccgaaagccttcatcacacacgcggcgttgctccatcaggctttcgcccattgtggaagattccctactgcagcctcccgtaggagtttgggccgtgtctcagtcccaatgtggccgatcagtctctcaactcggctatgcatcattgtcttggtaggcctttaccccaccaactaactaatgcaccgcggatccatctctaggtgacgccgaagcgccttttaactttttgtcatgcgacactaagttttattcggtattagcatctgtttccaaatgttatccccagccttgaggcaggttgtccacgtgttactcacccgttcgccactcacttgaaaggtgcaagcacctttcgctgtgcgttcgacttgcatgtattaggcacgccgccagcgttcatcctgagccaggatcaaactctcaatttgaaaatttgaagattgctcttcgattaaactgactatatttcgctatatctctataacgtaatccgtttattgtttgttacgaattgacttcgcaaatttgtttttgttactttacgtaacagctacagattcgtttgttcaaagttttgttcagttttcaatgtgctactcgttgtcgctgagacaactatattatcttaccacgctcgtttcgctttgtcaactacttcttttaagaagttttcgtcgacctcactgcccttacgctaaaaaaggcgctctgttgctcgtagggcgcttctgcaagttcttcaggtaaaagtaacaatccaagtggctaacgccttcacatcgtctcttttcatgcaataaacgtcatttaaacgcgcattgaaacgtgacagcatatctgaaccatccgccatgagctcttgattcagataggttttcgacacatcaatttctttgttagtgtgatggtcagttttacgttcaaaatggactgctaaaccagggactgcgccacgcgtatttttctttaaatgcgccatcaaaaatgcctcctcgaaaaaggttttccaagaccagtataacaccgttaaaaatctggtatagcctgttataccaaaattctattttggacaggctctgcgaggcgcgtcatcgacaagcgatgaccgtagcgtttccccttcctgctggggaaactgctattttacagcgccacttatccggcttgtaaaacctccggcgggtcacgccgtgacagggcaatttatcattgcaggatcactttcagtgagagcatgtcatgcagaacgttacccgcgtggggcaagctgatgtcagcttaaccacattaaaataatcggtaaacgtaagtgtataataacaaaaaaattgtagtggactatcgcaattaataggtgttatacaataaaagcaaacaaaaaggcacccttaaggtgcccacattattttaacgatcattaagatcatcaaaataacgtttgattgcgaacgtcacaacagcaacacagattgcgttaaacaattgtgtgagttcttgaaaaaagtaaatcatggagtctaaacctccttgccgttgcagttatagtaggaaacaacagctttttaagtatatcatgttttgaaataccaataatataatgttataatgttaatagaagaaagtacatggagactaacctctctagtaaaaagggctagtgcgtaggaacaccagctctttttgtttgtcttttttttttgaagcaagtttcctttcagggcaagacagtgtataattataaacaataactgccatgaaacagctctgctgtttcaaaggcttgggccagtacgctggtcaagcctggtggcccactttaaaatacagtgacgctgatagtatgatggctggactgttatttttgacaattaaagacgcttcaaaaaatttctttaacccccaaatcactaataggggggttaaatttacaaaaaagccaacaggcaaacaaccctcatgcttacggggcgtagggttacagcgaaataatattcgtgtataaattaatgtaataatgaaaatttgataataaaaatcggccgttaaatggcttttttattagataaatcatttttaggttgctatcaagctatttacgattaaggaggattatatgacatacaatgcgattaaaggacgctttacacacgttgcgcccgataaatcgatagtgtacggtgataagccttatacgtttgccttaacaccagaacaaagtgaacagattgaccaggcggtttatgcggttgtcctggccaaaaattataaaacgacctctttctcaattgatgagaagttaacgttgtctgacgaagaagtcacccaacacaaattaatggtccgtttacgcctccgcaaaaagcacaaacagccgtctcataaaccgctcacggactaaaatttcacaaataacaaaaggctagttttggggattatgagagctagaccaattattttaagctcaattcacaagaacagatcacagaaaaagcgccaaaccctatgaaattaaggcttggcgcttttaacttggtataagctgcattatgttaattcgttaaattaataatacccatatggactatattggtgtccaggtttaggttgcgtcttgccattcaattgatctagaaccttttgagggtcggctggatggtatacatgtccaattgcccctaaaacgtcgccaatccaatgtcatccgctaattttgttgcactctgaattagataactttttatagttacttaaatagcttttcataatatcgactatgagcgtaacatgattaaatagttaagataattacactcttcagaatgctaatattattcataattactaaaaagtgctagaatttgagatgaggagtgatcattcatatcctgtaatttcaattttcagtaagtacactgctaaaaatatagaggaaaattaaaatggaacagtccaataaaaaatatttctttgatgagccagcttttgatctacatgatggcggatatgtacctctcatagtaaataatgccccggaaatgcctttaaatataccacctattttaaaagcagatagagagtctaaaaatgatatctactataccgtcactgcaaaatcagggaaatcgcaaatattgccaggggaaaagacacaggcatggggttataatgctaattttttaggtaagactattatatttcaccgcggtcaaaaaaatcatatcactttgaagaatgacctgccagaattaactacttttcattggcatggagctgatgttagtggcccttatgttgatgggggttgtcacgcgcctgtttacccaggggaaatcaaacatattaattttacgttgaatcagcccgctgcgacattatggttgcatgctcacccatgtccatccacagcagaacaggtgtggcaaggattagctacaatggttattgttcaagatgagcatgaatcccaattatcaataccaagaaattatggagtagatgatattccaattattttacaagatagacattttcacaaagataatcagtttgattatcgtgccgattatgatcctgatggtgttgcaggtcccacggctgttatcaatggaacagtcaacccatacttcgatgtcacaacacaaaaaataaggttacgttttctaaatggtgctaaccgtcgggaatggcgtttgcatttttccgatgatttgccatttgatcagattgcgggggattgttctctattacccaagccaatcaagctgacaggtttaatgttgagctgtgctgaacgtgcagaagtcattattgattttagccaatatcatgaaggtgatgaggtaaccttatatactgatcaagtgccactattaaagttccgcattcacaatttcgcaaaagatactacaaaaattcccgatcatttaattaatttaaagaaaccgtcagttgaaccgtcattacccattcgacatgtcgtcatgcaaggaatggatgaaagtgttgccatagatgacaagaaatttgctatggaacgcattgatgccgagcaaatagttggagagtatcagtattgggatgtcacgaatagtaacgaaaaaccgggaatggttcacccatttcacatacacggcactcgctttttagtactaacacgtaatggaaaagatccatatccaaatgagaacggtttcaaagacaccattggagttaacccaggagaaactgttcgaatactagttaagtttgatttacctggtatatatatgtatcattgccatattttagaacatgaagatggtggtatgatggcacaaatagagatagtagatccaaaaaagccgcatcagaagtatcagttaatggatatgaatactttaatgaacgcgttagctgaggagcgtggtattgagttatctaatctttggatggcaggtatggagtcgtacgaaaaaatgggaatgaaaatgtaagattttgctagaatacttccgatgaaaaatggttgatcaatcatattcgctgttaaactattggtatgttaagattaagggaacaacatatttaaaaacaaaacatcactttaactacactacagttgccagtgtttcttttttagaaagcatgggatccactaagaaggtttgatcactatactctatttttacggtggcatttctaatttgttaaattttcatattaaattttaatgttcctatctatttaactctaactaacagttcaagtgccttttgatattgctcagatcctgtttctgcttctgaacaatttctaatattttcagcaataactaactttattgccttatcaagacttgctctgacagcagataactgtatgacgacctcttcacaaggacgctcttcatcaatcatattgacaattccatttatttggcctgctgatctctttaacctattttgtatattttcatactgatatgctattgtattcatacctgaacctcataagtcaattattttacaatgttttgtggatacatcaactgatacagtgaaaacgcaccatcaagatttttgacatttctgaatccattattaataaatattcgttcagctgtataacttcgttgacctgtagcacacgatacaatgataccagtatcttttggtatttgattaatacggtctcgtattttttctaacggaatatttatgaaaccattaattaatcccatagctctaatttcctgagaagatcgtacatcaattaataagtaaccatcacgcctgtaattctctaattcattatattgaatattatgagatcgactattaataatattttcagccacataaccggaaatatgaacgggatctttagctgctccgaaaggaggagcatacgttaattccagttcaggtaaatcatctactttcagcctaaatttgattgccgttgcaagaagatcaatacgcttatctaccccttcatttccaacagcttgggcacctataatatcaccagtatttgtaaaaataagtttcatcataacttgtgttgcgccaggataatagcttgcgtgatgataagaaaaagtatgagtcacatgataatttaaaccaagttgctttgcttgtttttcattaatacctgtacttgcagctgatttagaaaaaaccttaacgattgatgtgccaatctcaggtttatttttaatagataaaccgtgaatagcatcagcaacttgtcgcccatgtctgtttgctggtcccgctaatggaattagtgtttcctgttcagtaatttgatgaataacactgataacgtcaccaattgcataaatgttagagtcacttgttttaaaatcatgatccacaacaatgcctttattgggcccaacttttaggcctgcagctatggctatatcagaatttggtcgaattcctgcagcaataataacagcatcagcttgtattgacataccattatctaaataaagaatgtctctgctcaccttatttatagtagttcccgtattgatacgaacgtcattttttatgagctcattcgtaatcgactgtgccatctcaatatcaagatttggcaatatttggttagaacgttcaataagattgactgaaaaacctctcttaatcaaattttcagtaacttctataccaataaatccagcaccaagtaccgcaaccgttttaatactctcatctaaatggctcataatgttatctaaatcagggatattacgtaattgaaaaatgtttgattgagtatgaagcccctcaatcttaggtattacaggactagatcctaaagataatattaatttatcataatatagcttctcttgttggtcatcatgattgacagatatcatcttattatctctatcaatatgggtcacttcactgttaacacgtacatctatattaaacctacttcttaaatcatcagcggtttgcacaattaattgggagcgatgtttaatcgttttgctaatgtggtaaggtaacccacaatttgcaaaagaaacgaaagggcctttttcgaagactataatttcatctttttcagatagccttcgcagtctagtagcagctgacataccggctgctaccccccccactataataatcctcatgttatacctcttagatatacttttttaaagtattttcgatttcatctttaggatgaaatccaacaattttatcaatgacttgaccatttttcttaataattaacgtggggataccttgaatgcctagttggctggcaacctgtttattttcatcgatatttactgaggtaaactttattttaccgcctaattgattttcttctgataagtgttgtagtatagggtccatcatcttgcatggcgggcaccaatcagcacgaaaatcggtcaaagtaaccccttcttgtgtttcattttcaaatgtactatcagtaatttctttgattgttgcactcatttctgctttcctccaaatattctaggtttctatgattaagaaagaaggtaatatataccccctagggtatatattaccttctttcttagtttttagcaatctcatcaacaggctgctagaagtggtgaataaatttgtccaatagttggattattttgctgtcctgtaagcttcaccaatccaatagcgccattggccttctttgagaatttcaacttatccgcatttgccaatgttgtttctcttgctgtttggttgaattcatcagttccaccatagtaatccatgttatcgacagcatcatcactttgataattctcagtacctgtgttggattcaaaagttagataacgttctccatcaacctcaatcacgtgcggatcacgtaaggtaaagttatctcccgtatcatagtatcctgcatcgatccattgttgcagagtttggtaatgctcctcatcccctgtgaagagttcatgatcatcactaacttttgctacacgaacttcagtatccgtatatgccattgacaagttagcagttgacaaacgttgtactgtgcgtggttggtcagtttttgtatagaataattggatactgtcatcatcattgaccgttgcagatccagaccactgctgcttatcccacaatgcattgaagccaaagactggcccagcattcttccaattattgattgctgtatcaccattcttagtgtaaagcatgtaaatatgttgatcgttatcctcttttggagaacctgctaaagcaaaaacaatgttgtaaccatgataatttgcagtgacaccagtttttgcgtcttgtagtgcccaagaatcccatacatccaaatcttgtacttcaccactttgcgcatctgccgttgccattgctggcaaattcttaattgcatcagcattgaaatatggtacagacgtatctgaattcaaattagcaatgttatccgcaacatcttttaagttagcatatgtcatgttggtagttgaggtaccatcatcatttttagtaactaatgttgttttagagtttaaatcttttgacacactgtcgtctagtgtcacaactgaggtggtcgcttttttatcatcagtagtagcgtcagttgctgcatttttgtccgctacttttttcgaactatcatctgatgatactgctgccacattcgctttgtcgtcagttgttgcactcttagtatcatcaactgacgtagtttctttatcatcagttgtttctttgttagcatctactgtcttagtagtactatctgtagccttttcttgattggcttcagttgtcgttgcatcaggagtcgttgaattgactgtcgtttctttattaacatctgatggagctgttgtgtcagtattcacatcagttgttttgctcagtgtttctgtgtcagttgttgtagtattaccaaccgtgtctgcactaacagaactcactcccatagaaatagctgctactgttgctgctccagctacccatatcttccccgccttgtataacttctttctcatcgataagaactcccaatttagaattattgcatctcgtgcaactacgttaagtataaacgttcatcatttcaaaaatattacaaaaagttgttaaacgtataacatagttcattgttgaacaaaaatgaattaaataaacattaaaataataatattaatataagtctttaaatatcaatatcgattctattatcaacatttatgttttaattgtatataaatttttttaaatattaatatatgaaatcattcatgtgttttattgaactatatgaattactaaaatgaatctaccatagttaagtaaaggtgcagagtgtagccatagattacagtactttctaaattagaatgatcatgcctcaaaacaaaataaaaaaggctttcgcctcttctcaacaaaaaaggagaggtaatcctctcctacttcttaatgggccatccaggactcgaacctgggacctctgcgttatcaacacagcgctctaaccaactgagctaatggcccgtattccccttgcctactcttacatagacaaaagcgaatgacgggaatcgaacccgcatagccagcttggaaggctggaattctaccattgaactacattcgcaagcttttcttcgggatcctctccctatggcgctggacggaatcgaaccgccgacacatgcagcttcaatgcattgctctaccaactgagctacagagccatctcattgttcccaatgaacggtcacagcggggctcgaacccgcgatctcctgcgtgacaggcaggcgtcctaaccagctagaccatgcgaccaattgcgggagcaggatttgaacctacgaccttcgggttatgggcccgacgagctaccagactgctccatcccgcgattatattatgacaccttcttcaaatgcctaaggagaatgtgggattcgaacccacgcgccggtttcccgacctgacggttttcaagaccgttcccttcagccagacttgggtaattctccattatctttcttacttgtcctgcatggaccatgttggactcgaaccaacgaccggacggttatgagccgtctgctctaaccaactgagctaatggtcctaaatcgagcctatcgcggcaggggggatcgaaccctcgacctctcgggtatgaaccgaacgctctagccagctgagctacaccgcggtctgtcttgattagcttccctaatcaatcgggatgacaggattcgaacctgcgaccccctggtcccaaaccaggtgctctaccaagctgagctacatcccgaattagtctatcgagagcttatcgccccactaaacttaaaaaaagagtttgaattccttcaacctctatgcacctagcaggagtcgaacctgcaacctcctgattcgtagtcagacgctctatccaattgcgctataggtgcatatatgccggcgaccgggatcgaaccggtacgatatttctatcgcaggattttaagtcctgtgcgtctgcctattccgccacgccggcatagaagcggaagacgggattcgaacccgcgacccccaccatggcaaggtgatgttctaccactgaactacttccgcataaattatgccgactaaaggactcgaaccttcgacccccgctttacaagagcggtgctctaccaactgagctaagtcggcatcgcttatcccgacgtggcaagtttgacatgaatgtatcagatagtttgtttgggccttatacaccattgaatggtagcggtagtgtgattactgggacgcaattatttacttcaagaactgatacgtattcatattatgcagtacccgttgagggacgtagtgatttattattggtcacttcatatatgagtaatcgtaatgaaaaagctgggacaggaatgaatgccacgtttgcaccatcatttttgattcaaataagtgctgatggtatgagcacaaaagtattggatactgttttagctcaaggtacatggacttatgatggcaaaagtgctagcgttgaggaacttgtaggaaataaagcaacatcagaattaactgatatgaaaattggttgggttgacaataagttttatgttgataatgaattagccaatggctatgtctacgactatatcaatactagttattatttgtttaaaaatggtgttcgcttaagtggtgtgcaaaactatgcaaattcatattattatttcgatccagtaacatataaaagagttgataatgagattcatcaagataatacggggaagaaatattacttcggtaatgacggccgtgtgaagcaaggccaatttgctgtgaatggtgttgcttataactttggtaacgataaaacctattatgagcgaggctttgcatcaggttacttacaagatgtaacggataataatcagtggtactggtttgaaaatggttcaaagtacactgggttccgttattatatgggcacatattatttctttgaaacaggacaacgtcaagagagtaagtgggaaacagcctggggtatgaagtactacgttggtactgatggtcgtgcagtacaaggcgttcaaattattgatggacaagcttatgactttggtacgaatggaaccttcaacttgaaggggacagcgagtggctacttgtactcaccgtcattgtcaacagcgaatggtggttataattggtttgagaatggtaagccatatacaggcttccgctactacgaaggcacttattactggtttgtgaacggtgttcgtcaaaatgctggttggcgtgaagcatggggcatgaagtattatacggatgctagtggtcgtgcattgcaaggtatccaaatcattgatggacaagcatatgactttggtacaaatggtacgtataatttgaagagtgcagcgagtggctatttgtactcaccaagctattcaaaggccaatggtggttataactggtttgagaatggtaagccatacacaggattccgttattacatgggcacatattactggttcgtgaatttcagatagcttatttggaccttatacaccgttgaatggtagcggtagtgtgataacaggaacacaattagctgaatctagaacagatacttattcatattatgcagttcctgttgcaggacataatgatttgttgttaattacatcatacatgagtaaccgtgctgaaaaagctggcgttggacttaattctacggtagcaccatcattcttagttcaagtaggtgccgatggtaaaacaacaaaagtactagatactgttttagcacaaggaacatggacttataatggtaaaggcagtgttgacgaactagttggcacaaaagagacatcaaacataactggtaaaaagattggttggattgataataagttttatgtcaatgatcaagtagctaatggttaccaatatgattatacgaatgacgcgaattatttgtttaaagatggtgttcgccaaagtggtgtgcaagcttatgacaatacctattactactttgacccagtaacgtacaaacgagtagaaaatgacatccgcaaagcaacttggggattagaatattactttggtaacgacggtcgtgtgaagcaaggtcagtttgcagttaatggtgttgcttatgactttggtaatgacaaaacatacgctaagcgtggttttgcatcaggttacttacaagatgtaacggataacaatcagtggtactggtttgaaaatggttcaaagtatactggcttccgatactatcaaaatacttattacttcttcgagtcaggacaacgtcaagagagtaagtgggaaacagcctggggtatgaagtattacgttggtactgatggtcgtgcagtacaaggcgttcaaattattgatggacaagcttatgactttggtacgaatggaactttcaacttgaaggggacagcgaatggctacttgtactcaccatcattgtcaacagcgaatggtggttataattggtttgagaatggtaagccatatacaggcttccgttactacgaaggtacttattactggttcgtgaacggtgttcgtcaaaatgctggttggcgtgaagcatggggcatgaagtattatacggatgctagtggtcgtgcattgcaaggtatccaaatcattgatggacaagcctatgactttggtacaaatggtacgtataatttgaagagcgcagcgagtggctatttgtactcaccaagctattcaaaggccaatggtggttataactggtttgagaatggtaagccatatacaggcttccgttattacatgggcacatattactggttcgtgaacttttttatctagggctgaactgattaggcaacttttattttttgattggcaagactgattctttcgttgttgaaccaatgaatatacttggacacatctaaaattagatgtgcaatcgatggaaaccggaattgataaatcatttcacgctttaatagggagtgaaaactttcaattttggcattatcatatggatgtcctacttttgaatacgaatgatcaattttatgtcgctttaacaaattttcaaagccaaaactagtgaactgactgcccatatcagtatgtaaataatttggttttttatcagttgacagcgatctttgtagtgttgtaactaccaatttggtatccatcgtggcactgatttgatgggctaatatcttacgcgtttgtaactctaaaactgacgctaaatagacccactgaccattactcaactttaaataagtgatgtccatgctccaagcgttggcttcgggtaaatgcctgattaagttgggacgttgacgataatcaacagttgtcgttggtttgttaaatcgacgactcatgacagagtatatgccagcttctcgcattaaacgacgaactcggttggttccatgatgcaaattcagatcagctaatgctaatcgcagacgtggcgcgccataagctttatagttattttgccaaatttcacgcaacaaagcttttaagatcgtgtcttctcgttgtcgttggctctcagtatagtgaacccaatcaaagtaggtgcttttgggtattttgagtaggcgaagcaccatcatgagtttaaaatgctgttttagcaatgattggacaataggaaaatgggtcttacgtgttacttgcgatgttcgcccagcaaaacggccgcaatttttaaaatttcgttttcttctttgagtcttgcgacttctttctgcattgcattaaattgggcgcgagtcactggctgtccattaacatcagtcccaatgatttgggcttttttaacccaactagtgacggtttgcatagccaaatgggtattcattggctagagaattagcagaacggccctcgttatgcaaggcaacaatagatgatttaaattctgttgagtatcgcttagctttcataatataaaaaaactcctatacttgattatctcggattatgccctagaaataaagcggtccggattttcagtatacgagcatgctcttatactaaaaaaatggactatttttattcagtccgtaaaatgaaagtataggagtatttttatgtcaattcgttattcacaagatttcaaagattcattggttaaacttcaccaagaaggccgttcacttaaatcattagcagaagaatttggtccgtcgaaagattctattgctatttggcttaaacaagctaccccaatcatgatcaagggtcagtcaaagactttaaaagacgtcaagcaactagagaagcgcctcgctattttggaggaagaaaacgaaattttatcacacatagcctgacaggcattgagcggccatcttactagccaaaaaatagtccgtaatgtggtattgccgctcgttaaccaatttttagcacaaggctacgcgcttgtgcgtattttaagtgcacttaaaatcaaacctagtacctattacaactggcgccattggcagcccagtcgacaagaaaagcgtagagaatctctaaaaccttatattttagacgtttggaaaacctttaaattttatggttatcgccgtattgctgcttatagtcaacaaaccgacggtccgaaagtatctgggtatatgacactcaaattgatgcgtgaattagggattaaatcccgcatgcaaaaacgttatcgcaagccaaaaactgtggtgactgttgatcaaaagcccaatttgattagacacttgcatgatttgagcggtgtttggcaaacagatatcacttatattcagttgactaatcacagatgggtctatttagcgaccgttttggatcctgagaagagaaaagtattgggctataaaattggcgatacaatgacagccgagctagccacaagtgccttacagatggctttagataagcatcgaaagccattaattattcattcagatatggggtcacatacacgagtgctgaatttaatattaaatgtcaaaattatggcttgaaacattcatattcactcaaaggacatccatacgataatggccgtatggaagcatttcattcaatattgaaacgtgaagaggtgtatttgaaggcatacgaaacattaacgcaagtccaagcagccattggttggtatatcaatttttataatcgcaatcgtatctcaaatgttgcctaagtaactgaataaaaatagtccaatttattgacttctgagcacaatggacgctacagggatcgaacctgtgaccccctgcttgtaaggcaggtgctctcccagctgagctaagcgtccatgatggagaggaagggattcgaaccctcgaagcaagttcccctgcttacacggtttccaaccgtgctccttcggccagactcggacacctctccgattatcttcctactgctctcggtgttcgtcaaaatgcaggatggcgtgaagcatggggcaagaagtattatacagatgccaatggtcgagcattacaaggtattcaaaagatagatggtcagcaatataattttggaaatgatggcacatattacttacgttaaaatggtattaccgatgaaatcgaacgtgctaatattgtgccattgaacgggaaattttatctttttacagatacacgtttgagtaagagtgttgtgccaacagctgattttaatattaatgttggtatgatgggttatgtttaagtaaaggtaaaggcaaaagaacgaaaaggagggaaggggtaaaaaaagggcggataaagcgaatgaggaggtaaagtaaggggataaaaggggataaaaagcgaacgaaggaaagagataaaaaacaagtaaaaaaagtagttgacgagggggaataaagttggtatattagtatatgttccgacggagcgaagcgacgcaaagcgttgcgaggcaagggggagcgag

SEQ ID NO: 24 - skipped
